US010233258B2

(12) United States Patent
Akamatsu et al.

(10) Patent No.: US 10,233,258 B2
(45) Date of Patent: *Mar. 19, 2019

(54) BISPECIFIC BINDING PROTEINS THAT BIND CD40 AND MESOTHELIN

(71) Applicant: AbbVie Biotherapeutics Inc., Redwood City, CA (US)

(72) Inventors: Yoshiko Akamatsu, Palo Alto, CA (US); Patricia Culp, Oakland, CA (US); Charles M. Forsyth, Fremont, CA (US); Ping Y. Huang, Fremont, CA (US); David Powers, Fairfax, CA (US); Alan F. Wahl, Del Mar, CA (US); Shiming Ye, Palo Alto, CA (US)

(73) Assignee: AbbVie Biotherapeutics Inc., Redwood City, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 15/903,812

(22) Filed: Feb. 23, 2018

(65) Prior Publication Data
US 2018/0194862 A1 Jul. 12, 2018

Related U.S. Application Data

(63) Continuation of application No. 15/606,200, filed on May 26, 2017.

(60) Provisional application No. 62/342,393, filed on May 27, 2016, provisional application No. 62/414,897, filed on Oct. 31, 2016.

(51) Int. Cl.
C07K 16/46 (2006.01)
C07K 16/28 (2006.01)
C07K 16/30 (2006.01)
C07K 16/42 (2006.01)
A61K 38/00 (2006.01)

(52) U.S. Cl.
CPC ........ C07K 16/468 (2013.01); C07K 16/2803 (2013.01); C07K 16/2827 (2013.01); C07K 16/2863 (2013.01); C07K 16/2878 (2013.01); C07K 16/30 (2013.01); C07K 16/3069 (2013.01); C07K 16/42 (2013.01); A61K 38/00 (2013.01); C07K 2317/24 (2013.01); C07K 2317/31 (2013.01); C07K 2317/33 (2013.01); C07K 2317/56 (2013.01); C07K 2317/622 (2013.01); C07K 2317/64 (2013.01); C07K 2317/73 (2013.01); C07K 2317/75 (2013.01); C07K 2317/92 (2013.01)

(58) Field of Classification Search
None
See application file for complete search history.

(56) References Cited

U.S. PATENT DOCUMENTS

| 7,618,633 | B2 | 11/2009 | Bedian |
| 8,137,667 | B2 | 3/2012 | Jure-Kunkel |
| 8,337,850 | B2 | 12/2012 | Ahrens |
| 9,266,956 | B2 | 2/2016 | Zhang |
| 2009/0074711 | A1 | 3/2009 | Glennie |
| 2009/0311268 | A1 | 12/2009 | Thomas |
| 2010/0226925 | A1 | 9/2010 | Dillion |
| 2011/0027268 | A1 | 2/2011 | Kahnert |
| 2014/0004121 | A1 | 1/2014 | Fanslow |
| 2014/0044711 | A1 | 2/2014 | Ledbetter |
| 2014/0120103 | A1 | 5/2014 | Zhang |
| 2014/0154252 | A1 | 6/2014 | Thompson |
| 2014/0377253 | A1 | 12/2014 | Harding |
| 2017/0342169 | A1* | 11/2017 | Akamatsu ............ C07K 16/468 |

FOREIGN PATENT DOCUMENTS

| EP | 1707627 A1 | 10/2006 |
| EP | 2889377 A1 | 7/2015 |
| EP | 3130606 A1 | 2/2017 |
| WO | 2005123780 A2 | 12/2005 |
| WO | 2006099141 A2 | 9/2006 |
| WO | 2014065402 A1 | 5/2014 |
| WO | 2014144960 A2 | 9/2014 |
| WO | 2014161845 A1 | 10/2014 |
| WO | 2015066550 A1 | 5/2015 |
| WO | 2015091853 A2 | 6/2015 |
| WO | 2016069919 A1 | 10/2015 |
| WO | 2017182672 A1 | 4/2017 |

OTHER PUBLICATIONS

Alderson et al., 1993 "CD40 expression by human monocytes: regulation by cytokines and activation of monocytes by the ligand for CD40," J Exp Med 178(2):669-674.
Armitage et al., 1993 "CD40 ligand is a T cell growth factor," Eur J Immunol 23(9):2326-2331.
Bancherau et al., 1995 "Functional CD40 antigen on B cells, dendritic cells and fibroblasts," Adv Exp Med Biol 378:79-83.
Bancherau et al., 1998 "Dendritic cells and the control of immunity," Nature 392(6673)245-252.
Beatty et al. 2014 "Mesothelin-specific chimeric antigen receptor mRNA-engineered T cells induce anti-tumor activity in solid malignancies." Cancer Immunol Res 2:112-120 (13 pages).
Bishop, 2012 "The Power of Monoclonal Antibodies as Agents of Discovery: CD40 Revealed as a B Lymphocyte Costimulator," J Immunol 188:4127-4129.
Bensinger et al., 2012 "A phase 1 study of lucatumumab, a fully human anti-CD40 antagonist monoclonal antibody administered intravenously to patients with relapsed or refractory multiple myeloma," Br J Haematol 159:58-66.
Bloom et al., 1997 "Intrachain disulfide bond in the core hinge region of human IgG4," Protein Sci 6(2):407-415.
Bourgeois et al., 2002 "A role for CD40 expression on CD8+ T cells in the generation of CD8+ T cell memory," Science 297:2060-2063.
Burington et al., "CD40 Pathway Activation Status Predicts Response to CD40 Therapy in Diffuse Large B Cell Lymphoma," Sci Transl Med 3(74):1-12 (pp. 1-14), 2011.

(Continued)

Primary Examiner — Phillip Gambel

(57) ABSTRACT

The present disclosure provides bispecific proteins that bind to two antigens, as well as their compositions, uses, and methods of making.

10 Claims, 72 Drawing Sheets
Specification includes a Sequence Listing.

(56) References Cited

OTHER PUBLICATIONS

Ellmark et al., 2016 "Selective FcγR engagement by human agonistic anti-CD40 antibodies," Transl Cancer Res 5 (Suppl 4):S839-S841.
French et al., 1999 "CD40 antibody evokes a cytotoxic T-cell response that eradicates lymphoma and bypasses T-cell help," Nat Med 5(5):548-553.
Gladue et al., 2011 "The CD40 agonist antibody CP-870,893 enhances dendritic cell and B-cell activity and promotes anti-tumor efficacy in SCID-hu mice," Cancer Immunol Immunother 60(7):1009-1017.
Hernandez-Hoyos et al., 2013. "Prolonged cytotoxic activity induced by anti-PSMA x anti-CD3 ADAPTIRTM molecule, ES414, in the absence of significant cytokine release," AACR-NCI-EORTC International Conference on Molecular Targets and Cancer Therapeutics, Oct. 19-23, 2013, Boston, MA, Abstract B249.
Hollenbaugh et al., 1995 "Expression of Functional CD40 by Vascular Endothelial Cells," J Exp Med 182(1):33-40.
Houot et al. 2011 "Immunomodulating antibodies and drugs for the treatment of hematological malignancies," Cancer Metastasis Rev 30:97-109.
Jakob et al., 2013 "Structure reveals function of the dual variable domain immunoglobulin (DVD-Ig™) molecule," mAbs 5(3):358-363.
Johnson et al., 2005 "Clinical and Biological Effects of an Agonist Anti-CD40 Antibody: A Cancer Research UK Phase I Study," Clin Cancer Res 21(6):1321-1328.
Law et al., 2005 "Preclinical Antilymphoma Activity of a Humanized Anti-CD40 Monoclonal Antibody, SGN-40," Cancer Res 65(18):8331-8338.
Ledbetter et al., 1987 "Augmentation of normal and malignant B cell proliferation by monoclonal antibody to the B cell-specific antigen BP50 (CDW40)," J Immunol 138(3):788-794.
Li et al., "Inhibitory Fcy receptor engagement drives adjuvant and anti-tumor activities of agonistic CD40 antibodies," Science 333(6045):1030-1034, 2011.
Mackay et al., 1997 "Protective immunity induced by tumor vaccines requires interaction between CD40 and its ligand, CD154," Cancer Res 57(13):2569-2574.
Maldonado et al., 2010 "How tolerogenic dendritic cells induce regulatory T cells," Adv Immunol 108:111-165.
Mangsbo et al., 2015 "The Human Agonistic CD40 Antibody ADC-1013 Eradicates Bladder Tumors and Generates T-cell-Dependent Tumor Immunity," Clin Cancer Res 21(5):1115-1126.
Melero et al., 2013 "Clinical development of immunostimulatory monoclonal antibodies and opportunities for combination," Clin Cancer Res 19(5):997-1008.
Moran et al., 2013 "The TNFRs OX40, 4-1BB, and CD40 as targets for cancer immunotherapy," Curr Opin Immunol 25(2):1-12.
Pastan et al., 2014 "Discovery of mesothelin and exploiting it as a target for immunotherapy." Cancer Res 74(11):1-6.
Paulie et al., 1985 "A p50 surface antigen restricted to human urinary bladder carcinomas and B lymphocytes," Cancer Immunol Immunother 20(1):23-28.
Redman et al., 2015 "Mechanisms of action of therapeutic antibodies for cancer," Molecular Immunology 67:28-45.
Sewell et al., 2012 "Anti-PSMA x anti-CD3 bispecific antibody redirects T cell cytotoxicity in castrate-resistant prostate cancer models," 24th EORTC-NIC-AACR Symposium on Molecular Targets and Cancer Therapeutics, Nov. 6-9, 2012, Dublin, Ireland, Abstract 319.
Shalapour et al., 2015 "Immunity, inflammation, and cancer: an eternal fight between good and evil," J Clin Invest 125(9):3347-3355.
Shen et al., 2013 "Removal of a C-terminal serine residue proximal to the inter-chain disulfide bond of a human IgG1 lambda light chain mediates enhanced antibody stability and antibody dependent cell-mediated cytotoxicity," mAbs 5 (3):418-431.
Shen et al., 2014 "IL-35-producing B cells are critical regulators of immunity during autoimmune and infectious diseases," Nature 507(7492):366-370 (23 pages).
Sotomayor et al., 1999 "Conversion of tumor-specific CD4+ T cell tolerance to T-cell priming through in vivo ligatio of CD40," Nat Med 5(7):780-787.
Stamenkovic et al., 1989 "A B-lymphocyte activation molecule related to the nerve growth factor receptor and induced by cytokines in carcinomas," EMBO J 8(5):1403 1410.
Van Mierlo et al., 2002 "CD40 stimulation leads to effective therapy of CD40(-) tumors through induction of strong systemic cytotoxic T lymphocyte immunity," Proc Natl Acad Sci USA 99(8):5561-5566.
Vonderheide et al., 2013 "Agonistic CD40 Antibodies and Cancer Therapy," Clin Cancer Res 19(5):1035-1043.
White et al., 2011 "Interaction with FcyRIIB Is Critical for the Agonistic Activity of Anti-CD40 Monoclonal Antibody," J Immunol 187:1754-1763.
Wu et al., 2007 "Simultaneous targeting of multiple disease mediators by a dual-variable-domain immunoglobulin," Nat Biotechnol 25(11):1290-1297.
Yonezawa et al., 2015 "Boosting cancer immunotherapy with anti-CD137 antibody therapy," Clin Cancer Res 21 (14):3113-3120.

* cited by examiner

Mouse anti-human CD40 Antibody Domains
Variable domains (CDRs in bold)

muAb1 V<sub>H</sub> (SEQ ID NO: 1)
QVQLQQPGAELVKPGASVKMSCKASGYTFTSYWITWVKQRPGQGLEWIGEINPGSGSTNYNEKFKSKATL
TVDTSSSTAYMQLSSLTSEDSAVYYCARNRGTGDYWGQGTTLTVSS muAb1 V<sub>L</sub> (SEQ ID NO: 31)
DVVMTQTPLSLPVSLGDQASISCRSSQSLVHSYGNTYLHWYLQKPGQSPKFLIYKVSNRISGVPDRLSGSGS
GTDFTLKISRVEPEDLGVYFCSQSTHVPYTFGGGTKLEIK muAb2 V<sub>H</sub> (SEQ ID NO: 2)
QVQLQQSGAELMKPGASAKLSCKATGYTFTGYWIQWVKQRPGHGLEWIGEILPGGDHTKYNEKFRGKA
TFTSDTSSNTVYMQLSSLTTEDSAIYYCARVGGDYWGQGTTLTVSS muAb2 V<sub>L</sub> (SEQ ID NO: 32)
DVVMTQTPLSLPVSLGDQASISCRSSQSLVNSNENTYLHWYLQKPGQSPKLLIYKVFNRYSGVPDRFSGSGS
GTDFTLKISRVEAEDLGVYFCFQSTHVPWTFGGGTKLEIK muAb3 V<sub>H</sub> (SEQ ID NO: 3)
EVQLQQSGPELVKPGASVKISCKASGYTFTDYYMNWVKQSHGKSLEWIGDINPNNGGTSYNQKFKGKATL
TVDKSSSTAYMELRSLTSEDSAVYYCARRGGLGRGTYALDYWGQGTSVTVSS muAb3 V<sub>L</sub> (SEQ ID NO: 33)
DIQMTQTTSSLSASLGDRVTISCRASQDISNYLNWYQQKPDGTVKPLIYYTSRLHLGVPSRFSGSGSGTDYSL
TISNLEQEDIATYFCQQGNTLPLTFGAGTKLEIK

FIG. 3A

Mouse anti-human CD40 Antibody Domains
Variable domains (CDRs in bold)

muAb4 V$_H$ (SEQ ID NO: 4)
LVQPGGSLSLSCAASGFTFSDYYMSWVRQPPGKALEWLGFIRNKANGYTTEFSASVKGRFTISRDNSQSILY
LQMNALRAEDSATYYCARYGGWYFDVWGTGTTVTVSS muAb4 V$_L$ (SEQ ID NO: 34)
DIQMTQTTSSLSASLGDRVTISCRASQDIRNYLNWYQQKPDGTVKLLIYYTSRLHSGVPSRFSGSGSGTDYSL
TISNLEQEDIATYFCQQGKTLPWTFGGGSKLEMK muAb5 V$_H$ (SEQ ID NO: 5)
DVQLQESGPGLVEPSQSLFLTCSVTGYSITTNYNWNWIRQFPGNKLEWMGYIRHDGTNNYNPSLKNRISIIR
DTPKNQFFLKLNSVTTEDTAIYFCTRLDYWGQGTSVTVSS muAb5 V$_L$ (SEQ ID NO: 35)
DAVMTQTPLSLPVSLGDQASISCRSSQSLENSYGNTFLNWFLQRPGQSPQLLIYRVSNRFCGVPDRFSGSGS
GTDFTLKISRVEAEDLGIYFCLQVTHVPYTFGGGTKLEIK muAb6 V$_H$ (SEQ ID NO: 6)
QVQLQQPGAELVRPGSSVKLSCKASGYTFTSYWMHWVKQRPIQGLEWIGNIDPSNGETHYNQKFKDKAT
LTVDKSSSTAYMQLSLTSEDSAVYYCARERIYYSGSTYDGYFDVWGTGTTVTVSS muAb6 V$_L$ (SEQ ID NO: 36)
QIVLTQSPAIMSASPGEKVTMTCSASSSLSYMHWYQQKSGTSPKRWIYDTSKLASGVPARFSGSGSGTSYSL
TISSMEAEDAATYYCQQWSSNPWTFGGGTKLEIK muAb7 V$_L$ (SEQ ID NO: 37)
QIVLTQSPAIMSASPGEKVTMTCSASSSLSYMHWYQQKSGTSPKRWIYDTSKLASGVPARFSGSGSGTSYSL
TISSMEGEDGATYYCQQWSSNPWTFGGGTKLEIK

*FIG. 3B*

Mouse anti-human CD40 Antibody Domains
Variable domains (CDRs in bold)

muAb8 V$_H$ (SEQ ID NO: 7)
QVQLQQSGPELVKSGASVKISCKASGYTFTDYYINWVKQRPGQGLEWIGWIFPGSGSVVYCNEQFKGQATL
TVDRSSSTAYMLLSSLTSEDSAVYFCASSLGKFAYWGQGTLVTVSA muAb8 V$_L$ (SEQ ID NO: 38)
DIVMTQSQKFMSTTVGDRVSITCKASQSVVTAVAWYQQKPGQSPKLLIYSASNRYTGVPDRFTGSGSGTDF
ALTIRTMQSEDLADYFCQQYSSYPYTFGGGTKLEIK muAb9 V$_H$ (SEQ ID NO: 8)
DVQLQESGPGLVKPSQSLSLTCSVTGYSITSNYYWNWIRQFPGNKLEWMGYIRYDGSNNYNPSLKNRISITR
DTSKNQFFLKLNSVTTEDTATYYCARLDYWGQGTLTVSS muAb9 V$_L$ (SEQ ID NO: 39)
DAVMTQTPLSLPVSLGDQASISCRSSQSLENTNGNTFLNWFLQKPGQSPQLLIYRVSNRFSGVPDRFSGSGS
GTDFTLKISRVEAEDLGVYFCLQVTHVPFTFGSGTKLEIK muAb10 V$_H$ (SEQ ID NO: 9)
DVQLQESGPGLVKPSQSLSLTCSVTGYSITSNYYWNWIRQFPGNKLEWMGYIRYDGSNNYNPSLKNRISITR
DTSKNQFFLRLNSVTTEDTATYYCTRLDYWGQGTLTVSS muAb10 V$_L$ (SEQ ID NO: 40)
DAVMTQTPLSLPVSLGDQASISCRSSQSLENSNGNTFLNWFLQKPGQSPQLLIYRISNRFSGVPDRFSGSGSG
TDFTLKISRVEAEDLGVYFCLQVTHVPFTFGSGTKLEIK

FIG. 3C

Humanized anti-human CD40 Antibody Domains
Variable domains (CDRs in bold)

huAb6-1 V$_H$ (SEQ ID NO: 10)
EVQLVQSGAEVKKPGSSVKVSCKASGYTFTSYWMHWVRQAPGQGLEWIGNIDPSNGETHYNQKFKDRATLTVDKST
STAYMELSSLRSEDTAVYYCARERIYYSGSTYDGYFDVWGQGTTVTVSS huAb6-1 V$_L$ (SEQ ID NO: 41)
DIQLTQSPSFLSASVGDRVTITCSASSSLSYMHWYQQKPGKSPKRWIYDTSKLASGVPSRFSGSGSGTEYTLTISSLQPED
FATYYCQQWSSNPWTFGGGTKVEIK huAb6-2 V$_H$ (SEQ ID NO: 11)
EVQLVQSGAEVKKPGSSVKVSCKASGYTFTSYWMHWVRQAPGQGLEWIGNIDPSNGETHYNQKFKDRVTITVDKST
STAYMELSSLRSEDTAVYYCARERIYYSGSTYDGYFDVWGQGTTVTVSS huAb6-3 V$_H$ (SEQ ID NO: 12)
EVQLVQSGAEVKKPGSSVKVSCKASGYTFTSYWMHWVRQAPGQGLEWIGNIDPSNGETHYAQKFQGRVTITVDKST
STAYMELSSLRSEDTAVYYCARERIYYSGSTYDGYFDVWGQGTTVTVSS huAb8-1 V$_H$ (SEQ ID NO: 13)
EVQLVQSGAEVKKPGSSVKVSCKASGYTFTDYYINWVRQAPGQGLEWIGWIFPGSGSVYCNEQFKGRATLTVDRSTS
TAYMELSSLRSEDTAVYFCASSLGKFAYWGQGTLVTVSS huAb8-1 V$_L$ (SEQ ID NO: 42)
DIQMTQSPSSLSASVGDRVTITCKASQSVVTAVAWYQQKPGKSPKLLIYSASNRYTGVPSRFSGSGSGTDFTLTISSLQPE
DFATYFCQQYSSYPYTFGGGTKVEIK huAb8-2 V$_H$ (SEQ ID NO: 14)
EVQLVQSGAEVKKPGSSVKVSCKASGYTFTDYYINWVRQAPGQGLEWIGWIFPGSGSVYSNEQFKGRATLTVDRSTS
TAYMELSSLRSEDTAVYFCASSLGKFAYWGQGTLVTVSS

FIG. 3D

Humanized anti-human CD40 Antibody Domains
Variable domains (CDRs in bold)

huAb8-3 V$_H$ (SEQ ID NO: 15)
EVQLVQSGAEVKKPGSSVKVSCKASGYTFTDYYINWVRQAPGQGLEWIGWIFPGSGSVYCNEQFKGRVTITVDKSTS
TAYMELSSLRSEDTAVYYCASSLGKFAYWGQGTLVTVSS huAb9-1 V$_H$ (SEQ ID NO: 16)
EVQLQESGPGLVKPSETLSLTCTVSGYSITSNYYWNWIRQPPGKGLEWMGYIRYDGSNNYNPSLKNRITISRDTSKNQF
SLKLSSVTAADTAVYYCARLDYWGQGTTVTVSS huAb9-1 V$_L$ (SEQ ID NO: 43)
DAVMTQTPLSLSVTPGQPASISCRSSQSLENTNGNTFLNWFLQKPGQSPQLLIYRVSNRFSGVPDRFSGSGSGTDFTLKIS
RVEAEDVGVYFCLQVTHVPFTFGQGTKLEIK huAb9-2 V$_H$ (SEQ ID NO: 17)
EVQLQESGPGLVKPSETLSLTCTVSGYSITSNYYWNWIRQPPGKGLEWMGYIRYDGSNNYNPSLKNRVTISRDTSKNQF
SLKLSSVTAADTAVYYCARLDYWGQGTTVTVSS huAb9-3 V$_H$ (SEQ ID NO: 18)
EVQLQESGPGLVKPSETLSLTCTVSGYSISSNYYWNWIRQPPGKGLEWMGYIRYDGSNNYNPSLKSRVTISRDTSKNQF
SLKLSSVTAADTAVYYCARLDYWGQGTTVTVSS huAb9 Stab1 V$_H$ (SEQ ID NO: 19)
EVQLVESGGGLVQPGGSLRLSCAASGYSITSNYYWNWIRQPPGKGLEWMGYIRYDGSNNYNPSLKGRVTISRDTSKNQ
FYLKLSSVTAADTAVYYCARLDYWGQGTTVTVSS huAb9 Stab2 V$_H$ (SEQ ID NO: 20)
EVQLVESGGGLVQPGGSLRLSCAASGYSITSNYYWNWIRQPPGKGLEWMGYIRYDGSNNYNPSLKGRVTIS
RDTSKNQLYLKLSSVTAADTAVYYCARLDYWGQGTLVTVSS

FIG. 3E

Humanized anti-human CD40 Antibody Domains
Variable domains (CDRs in bold)

huAb9 Stab3 V_H (SEQ ID NO: 21)
EVQLVESGGGLVKPGETLILTCTVSGYDITSNYYWNWIRQPPGKGLEWMGYIRYDGSNNYNPSLKGRVTIS
RDTSKNQFYLKLSSVTAADTAVYYCARLDYWGQGTTVTVSS huAb9 rehuVH4 V_H (SEQ ID NO: 22)
QVQLQESGPGLVKPSETLSLTCTVSGYSITSNYYWNWIRQPPGKGLEWMGYIRYDGSNNYNPSLKNRITISR
DTSKNQFSLKLSSVTAADTAVYYCARLDYWGQGTLVTVSS huAb9 rehuVH3 V_H (SEQ ID NO: 23)
EVQLVESGGGLVQPGGSLRLSCAASGYSITSNYYWNWVRQAPGKGLEWMGYIRYDGSNNYNPSLKNRITI
SRDTSKNTFYLQMNSLRAEDTAVYYCARLDYWGQGTLVTVSS huAb9-4 V_L (SEQ ID NO: 44)
DAVMTQTPLSLSVTPGQPASISCRSSQSLENTNGNTFLNWYLQKPGQSPQLLIYRVSNRFSGVPDRFSGSGS
GTDFTLKISRVEAEDVGVYYCLQVTHVPFTFGQGTKLEIK huAb9 Stab1 V_L (SEQ ID NO: 45)
DAVMTQTPLSLSVTEGQPASISCRSSQSLENTNGNTFLNWYLQKPGQSPQLLIYRVSNRFSGVPDRFSGSGS
GTDFTLKISRVEAEDVGVYYCLQVTHVPFTFGQGTKLEIK huAb9 Stab3 V_L (SEQ ID NO: 46)
DAVMTQTPLSLAVLPGQPASISCRSSQSLENTNGNTFLNWYLQKPGQSPQLLIYRVSNRFSGVPDRFSGSGS
GTDFTLKISRVEAEDVGVYYCLQVTHVPFTFGQGTKLEIK huAb9 Stab VK1 V_L (SEQ ID NO: 47)
DIQMTQSPSSLSASVGDRVTITCRSSQSLENTNGNTFLNWYQQKPGKAPKLLIYRVSNRFSGVPSRFSGSGSG
TDFTLTISSLQPEDFATYYCLQVTHVPFTFGQGTKVEIK

*FIG. 3F*

Humanized anti-human CD40 Antibody Domains
Variable domains (CDRs in bold)

huAb9 rehu VK2 V_L (SEQ ID NO: 48)
DAVMTQSPLSLPVTLGEPASISCRSSQSLENTNGNTFLNWFQQKPGQSPRLLIYRVSNRFSGVPDRFSGSGSG
TDFTLKISRVEAEDVGVYYCLQVTHVPFTFGQGTKLEIK huAb9 rehu VK1 V_L (SEQ ID NO: 49)
DAQMTQSPSSLSASVGDRVTITCRSSQSLENTNGNTFLNWFQQKPGKAPKLLIYRVSNRFSGVPSRFSGSGS
GTDFTLTISSLQPEDFATYYCLQVTHVPFTFGQGTKLEIK huAb9 A21 V_L (SEQ ID NO: 50)
DIVMTQTPLSLSVTPGQPASISCRSSQSLENTNGNTFLNWYLQKPGQSPQLLIYRVSNRFSGVPDRFSGSGSG
TDFTLKISRVEAEDVGVYYCLQVTHVPFTFGQGTKLEIK huAb9 A2V V_L (SEQ ID NO: 51)
DVVMTQTPLSLSVTPGQPASISCRSSQSLENTNGNTFLNWYLQKPGQSPQLLIYRVSNRFSGVPDRFSGSGS
GTDFTLKISRVEAEDVGVYYCLQVTHVPFTFGQGTKLEIK

FIG. 3G

Human anti-human Mesothelin Antibody Domains
Variable domains (CDRs in bold)

HuAb17 V$_H$ (SEQ ID NO:107)
EVQLVQSGAEVKEPGASVKVSCKASGDTFNRYYVHWARQAPGQGLEWMGIINPSGVSTTYAQKFQGRVT
MTRDTPTNTVYMELGSLRPEDTAVYFCAESRGSGYNYFAMDVWGQGTLVTVSS

HuAb17 V$_L$ (SEQ ID NO:136)
SYELTQPPSVSVSPGQTADITCSGDKLGDKYASWYQQKPGQSPVLVIYQDNRRPSGIPERFSGSNSGNTATLT
ISGTQAMDEADYYCQAWDSDTYVFGPGTKVTVL

HuAM1 V$_H$ (SEQ ID NO:108)
EVQLVQSGAEVKKPGASVKVSCKASGDTFKRYYVQWVRQAPGQGLEWMGIINPSGVSTTYAQKFQGRVT
MTRDTSTSTVYMELSSLRSEDTAVYYCAESRGSGYNYFAMDVWGQGTLVTVSS

HuAM1 V$_L$ (SEQ ID NO:137)
SYELTQPPSVSVSPGQTASITCSGDKLGDKYASWYQQKPGQSPVLVIYQDNRRPSGIPERFSGSNSGNTATLT
ISGTQAMDEADYYCQAWDSDTYVFGTGTKVTVL

HuAM2 V$_H$ (SEQ ID NO:109)
EVQLVQSGAEVKKPGASVKVSCKASGYTFKRYYVHWVRQAPGQGLEWMGIINPSGVSTTYAQKFQGRVT
MTRDTSTSTVYMELSSLRSEDTAVYYCAESRGSGYNYFAMDVWGQGTLVTVSS

HuAM3 V$_H$ (SEQ ID NO:110)
EVQLVQSGAEVKKPGASVKVSCKASGDTFKRYYVHWVRQAPGQGLEWMGIINPSGVSTTYAQKFQGRVT
MTRDTSTSTVYMELSSLRSEDTAVYYCAESRGSGYNYFAMDVWGQGTLVTVSS

HuAM4 V$_H$ (SEQ ID NO:111)
EVQLVQSGAEVKKPGASVKVSCKASGDTFNRYYVHWVRQAPGQGLEWMGIINPSGVSTTYAQKFQGRVT
MTRDTSTSTVYMELSSLRSEDTAVYYCAESRIPGYNNFAMDVWGQGTLVTVSS

*FIG. 4A*

Human anti-human Mesothelin Antibody Domains
Variable domains (CDRs in bold)

HuAM5 V$_H$ (SEQ ID NO:112)

EVQLVQSGAEVKKPGASVKVSCKASGDTFNRYYVHWVRQAPGQGLEWMG**IINPSGVSTTYAQKFQGRVT
MTRDTSTSTVYMELSSLRSEDTAVYYCAEVRGSGYNYFAMDV**WGQGTLVTVSS

HuAM6 V$_H$ (SEQ ID NO:113)

EVQLVQSGAEVKKPGASVKVSCKASGDTFNRYYVHWVRQAPGQGLEWMG**IINPSGVSTTYAQKFQGRVT
MTRDTSTSTVYMELSSLRSEDTAVYYCAESRVPGYNNFAMDV**WGQGTLVTVSS

HuAM7 V$_H$ (SEQ ID NO:114)

EVQLVQSGAEVKKPGASVKVSCKASGDTFNRYYVHWVRQAPGQGLEWMG**IINPSGVSTTYAQKFQGRVT
MTRDTSTSTVYMELSSLRSEDTAVYYCAESRGSGYNYFGMDV**WGQGTLVTVSS

HuAM8 V$_H$ (SEQ ID NO: 115)

EVQLVQSGAEVKKPGASVKVSCKASGDTFNRYYVHWVRQAPGQGLEWMG**IINPSGVSTTYAQKFQGRVT
MTRDTSTSTVYMELSSLRSEDTAVYYCAESRGSGYNYFAMDV**WGQGTLVTVSS

HuAM8 V$_L$ (SEQ ID NO: 138)

SYELTQPPSVSVSPGQTASITCSGDNLGYKYVSWYQQKPGQSPVLVIYQDHRRPSGIPERFSGSNSGNTATLT
ISGTQAMDEADYYCQAWDTDTYVFGTGTKVTVL

HuAM9 V$_H$ (SEQ ID NO: 116)

EVQLVQSGAEVKKPGASVKVSCKASGDTFNRYYVQWVRQAPGQGLEWMG**IINPSGVSTTYAQKFQGRVT
MTRDTSTSTVYMELSSLRSEDTAVYYCAETRGSGYNYFGMDV**WGQGTLVTVSS

*FIG. 4B*

Human anti-human Mesothelin Antibody Domains
Variable domains (CDRs in bold)

HuAM11 V$_H$ (SEQ ID NO: 117)
EVQLVQSGAEVKKPGASVKVSCKASGDTFKRYYMHWVRQAPGQGLEWMGIINPSGVSTTYAQKFQGRV
TMTRDTSTSTVYMELSSLRSEDTAVYYCAEVRGSGFNYFGMDVWGQGTLVTVSS

HuAM11 V$_L$ (SEQ ID NO: 139)
SYELTQPPSVSVSPGQTASITCSGDKLGDKYASWYQQKPGQSPVLVIYQDNRRPSGIPERFSGSNSGNTATLT
ISGTQAMDEADYYCQVWDSDTYVFGTGTKVTVL

HuAM12 V$_H$ (SEQ ID NO: 118)
EVQLVQSGAEVKKPGASVKVSCKASGDTFHRYYVHWVRQAPGQGLEWMGIINPSGVSTTYAQKFQGRVT
MTRDTSTSTVYMELSSLRSEDTAVYYCAEVRGSGFNYFGMDVWGQGTLVTVSS

HuAM13 V$_H$ (SEQ ID NO: 119)
EVQLVQSGAEVKKPGASVKVSCKASGDTFNRYYVQWVRQAPGQGLEWMGIINPSGVSTTYAQKFQGRVT
MTRDTSTSTVYMELSSLRSEDTAVYYCAETRGSGFNYFGMDVWGQGTLVTVSS

HuAM15 V$_H$ (SEQ ID NO: 120)
EVQLVQSGAEVKKPGASVKVSCKASGDTFKRYYVHWVRQAPGQGLEWMGIINPSGVSTTYAQKFQGRVT
MTRDTSTSTVYMELSSLRSEDTAVYYCAEVRGSGFNYFGMDVWGQGTLVTVSS

HuAM17 V$_H$ (SEQ ID NO: 121)
EVQLVQSGAEVKKPGASVKVSCKASGDTFNRYYVHWVRQAPGQGLEWMGIINPSGVSTTYAQKFQGRVT
MTRDTSTSTVYMELSSLRSEDTAVYYCAESRVPGYNIFAMDVWGQGTLVTVSS

HuAM18 V$_H$ (SEQ ID NO: 122)
EVQLVQSGAEVKKPGASVKVSCKASGDTFNRYYVHWVRQAPGQGLEWMGIINPSGVSTTYAQKFQGRVT
MTRDTSTSTVYMELSSLRSEDTAVYYCAETRGSGYNYFGMDVWGQGTLVTVSS

*FIG. 4C*

Human anti-human Mesothelin Antibody Domains
Variable domains (CDRs in bold)

HuAM19 V$_H$ (SEQ ID NO: 123)
EVQLVQSGAEVKKPGASVKVSCKASGDTFKRYYAHWVRQAPGQGLEWMGIINPSGVSTTYAQKFQGRVT MTRDTSTSTVYMELSSLRSEDTAVYYCAESRLPGYNAFAMD**VWGQGTLVTVSS

HuAM19 V$_L$ (SEQ ID NO: 140)
SYELTQPPSVSVSPGQTASITCSGDMLGYQYGSWYQQKPGQSPVLVIYQDNRRPSGIPERFSGSNSGNTATL TISGTQAMDEADYYCQAWDGDAFVFGTGTKVTVL

HuAM21 V$_H$ (SEQ ID NO: 124)
EVQLVQSGAEVKKPGASVKVSCKASGDTFNRYYVQWVRQAPGQGLEWMGIINPSGVSTTYAQKFQGRVT MTRDTSTSTVYMELSSLRSEDTAVYYCAETRGPGFNYFGMD**VWGQGTLVTVSS

HuAM15 Stab2 V$_H$ (SEQ ID NO: 125)
EVQLVQSGAGLVQPGGSVRVSCAASGFTFKRYYVHWVRQAPGKGLEWMGIINPSGVSTTYAQKFQGRVT ISRDNSKNTLYMQLNSLRAEDTAVYYCARVRGSGFNYFGMD**VWGQGTLVTVSS HuAM15 Stab3 V$_H$ (SEQ ID NO: 126)
EVQLVESGAGLVQPGESVKVSCKPGESVKVKPGESVKVSCAASGFTFKRYYVHWVRQAPGKGLEWMGIINPSGVSTTYAQKFQGRVT SRDNSTNTLYMELNSLRAEDTAVYYCARVRGSGFNYFGMD**VWGQGTLVTVSS HuAM15 Stab4 V$_H$ (SEQ ID NO: 127)
EVQLVESGAGVVKPGESVKVSCAASGFTFKRYYVHWVRQAPGKGLEWMGIINPSGVSTTYAQKFQGRVT MSRDTSTSTVYMELNSLRAEDTAVYYCARVRGSGFNYFGMD**VWGQGTLVTVSS HuAM15 Stab VH3 V$_H$ (SEQ ID NO: 128)
EVQLVESGGGLVQPGGSLRLSCAASGFTFKRYYVHWVRQAPGKGLEWMGIINPSGVSTTYAQKFQGRFTI SRDNSKNTLYLQMNSLRAEDTAVYYCARVRGSGFNYFGMD**VWGQGTLVTVSS

*FIG. 4D*

Human anti-human Mesothelin Antibody Domains
Variable domains (CDRs in bold)

MSLN76923 V$_H$ (SEQ ID NO: 129)
EVQLLESGGGLVQPGGSLRLSCAASGFTFSSYAMSWVRQAPGKGLEWVSAISGGGRTYYADSVKGRFTISRDNSKNTLYLQMNSLRAEDTAVYYCAREEMAFRAYRFDIWGQGTLVTVSS

HuAM15 Stab VL3 V$_L$ (SEQ ID NO: 141)
SYELTQPPSVSVAPGQTARISCSGDKLGDKYASWYQQKPGQAPVLVIYQDNRRPSGIPERFSGSNSGNTATLTISGTQAEDEADYCQAWDSDTYVFGGGTKLTVL HuAM15 Stab VK V$_L$ (SEQ ID NO: 142)
DIQMTQSPSSLSASVGDRVTITCSGDKLGDKYASWYQQKPGKAPKLLIYQDNRRPSGVPSRFSGSGSGTDFTLTISSLQPEDFATYYCQAWDSDTYVFGQGTKVEIK MSLN76923 V$_L$ (SEQ ID NO: 143)
DIQMTQSPSSLSASVGDRVTITCRASQSISSYLNWYQQKPGKAPKLLIYAASSLQSGVPSRFSGSGSGTDFTLTISSLQPEDFATYYCQQSYITPLTFGGGTKVEIK

*FIG. 4E*

Rat Anti-4-1BB Antibody Domains
Variable domains (CDRs in bold)

TABBY101 V$_H$ (SEQ ID NO:61)

QIQLVQSGPELKKPGESVKISCKASGYTFTDFAIHWVKQAPGKGLKWMGWINTYTGKPTYADDFKGRFVFSLEASAS
TANLQISNLKNEDTATYFCSRGAPRPTNWGQGTLVTVSS

TABBY101 V$_L$ (SEQ ID NO:81)

DIQMTQSPASLSASLGETVSIECLASEDIYNNLAWYQQKPGKSPQLLIYYESRLQDGVPTRFSGSGSGTQYSLKINSLESE
DAATYFCLQDSEYPYTFGAGTKLELK

TABBY102 V$_H$ (SEQ ID NO:62)

QVQLQQSGAELAKPGSSVKISCKASGYTLTSYYLNWIKQTTGGQLEYIGYIDTGSGGSHYNEKFKGKATLTVDKSSST
AFMQLSSLTPVDSAVYYCARGGYYDGFFDYWGQGVMVTVSS

TABBY102 V$_L$ (SEQ ID NO:82)

DIQMTQSPASLSASLGETVSIECLASEGISNDLAWYQQKSGKSPQFLIYAASRLQDGVPSRFSGSGSGTRYSLKISGMQPE
DEADYFCQQSYKYPPTFGSGTKLEIK

TABBY103 V$_H$ (SEQ ID NO:63)

QVQLQQSGAELVKPGSSVKISCKASDYTFTSNFLHWIKQQPGNGLEWIGWINPGDGDTYYNQKFNGKATLTADKSST
TAYMQLSSLTSEDSAVYFCAGGNYYAAHYPPGPWYFDFWGPGTMVTVSS

TABBY103 V$_L$ (SEQ ID NO:83)

DTVLTQSPALAVSLGQRVTISCRASKSVSIYMHWYQQKSGQQPKFLIYTASNLESGVPSRFSGSGSGTDFTLTIDPVEAD
DIANYYCQQSNELPFTFGSGTKLEIK

*FIG. 7A*

Rat Anti-4-1BB Antibody Domains
Variable domains (CDRs in bold)

TABBY104 V$_H$ (SEQ ID NO:64)

QVTLKESGPGILQPSQTLSLTCTFSGFSLSTDGLGVTWIRQPSGKGLEWLANIWWDDDKDYNPSLKNRLTISKDTSNPQ
AFLKITNVDTADTATYCARIVPNSGHEDYWGQGVMVTVSS

TABBY104 V$_L$ (SEQ ID NO:84)

DIQMTQSPSFLSASVGDRVTINCKASQNINRYLNWYQQKLGEAPKLLMYNTNSMQTGIPSRFSGSGSGTDFTLTISSLQP
EDVATYFCLQHNSWPRTFGGGTKLELK

TABBY105 V$_H$ (SEQ ID NO:65)

EVQLVESGGGLVQPGRSMKLSCAASGFTFNNYDMAWVCQAPKRGLEWVATISYDGSTTYYRDSVKGRFTFSRDNAK
STLYLQMDSLRSEDTATYCARVGAGDFDYWGQGVMVTVSS

TABBY105 V$_L$ (SEQ ID NO:85)

DIRMTQSPVSLSTSLGETVNIECLASEDIYSDLAWYQQKPGKSPQLLIYSTNTLQNGVPSRFSGSGSGTQYSLKINSLQSE
DVATYFCQQNNNYPYTFGAGTKLELK

TABBY106 V$_H$ (SEQ ID NO:66)

QVQLQQSGAELAKPGTSVKLSCKASGYTFTSYYIYWVKQRPGQGLEWIGNIWPGNGGTFYGEKFMGKAT
FTADTSSSTAYMLLGSLTPEDSAYYFCARRPDYSGDDYFDYWGQGVLVTVSS

TABBY106 V$_L$ (SEQ ID NO:86)

QVVLTQPKSVSTSLKSTVKLSCKLNSGNIGSYYVHWYQQHAGRSPTTMIYRDDKRPDGVPDRFSGSIDSSSN
SAFLTINNVQTEDDAIYFCHSYDSTITPVFGGGTKLTVL

FIG. 7B

Rat Anti-4-1BB Antibody Domains
Variable domains (CDRs in bold)

TABBY107 V$_H$ (SEQ ID NO:67)

QVKLVQSGAALVKPGASVKMSCKASDYTFNDYWVSWVKQRHGESLEWIGEIYPNSGATNFNGKFRGKAT
LTVDNPTSTAYMELSRLTSEDSAIYYCTREYTRDWFAYWGQGTLVTVSS

TABBY107 V$_L$ (SEQ ID NO:87)

DVVLTQTPSILSATIGQSVSISCRSSQSLLDSDGNTYLYWFLQRPGQSPQRLIYLVSNLGSGVPNRFSGSGSGT
DFTLKISGVEAEDLGIYYCMQPTHAPYTFGAGTKLELK

TABBY108 V$_H$ (SEQ ID NO:68)

EIQLQESGPGLVRPSQSLSLACSVTGYTITSAYDWSWIRKFPGNKMEWMGYIAYIGFTNSNPSLKSRISITRD
TSKNQFFLQLKSVTTEDTATYYCARWSSYIPRYFDFWGPGTMVTVSS

TABBY108 V$_L$ (SEQ ID NO:88)

QAVLTQPNSVSTSLGSTVKLSCTITSGNIEDNFVHWVYQHYEGRSPTTMIHNDDKRPDGVPDRFSGSIDSSSNS
AFLTINNVEIEDEAIYFCHSYVSSINIFGGGTKLTVL

*FIG. 7C*

Humanized Anti-4-1BB Antibody Domains
Variable domains (CDRs in bold)

hu106.1x V<sub>H</sub> (SEQ ID NO:69)

EVQLVQSGAEVKKPGSSVKVSCKASGYTFTSYYIYWVRQAPGQGLEWIGNIWPGNGGTFYGEKFMGRAT
FTADTSTSTAYMELSSLRSEDTAVYYCARRPDYSGDDYFDYWGQGTLVTVSS hu106.1x V<sub>L</sub> (SEQ ID NO:89)

NVMLTQPHSVSESPGKTVTISCKLNSGNIGSYYVHWYQQRPGSSPTTMIYRDDKRPDGVPDRFSGSIDSSSN
SASLTISGLKTEDEADYYCHSYDSTITPVFGGGTKLTVL hu106.1y V<sub>H</sub> (SEQ ID NO:70)

EVQLVESGGGLVQPGGSLRLSCAASGYTFTSYYIYWVRQAPGKGLEWIGNIWPGNGGTFYGEKFMGRAT
FSADTSKNTAYLQMNSLRAEDTAVYYCARRPDYSGDDYFDYWGQGTLVTVSS hu106.2x V<sub>L</sub> (SEQ ID NO:90)

QVVLTQPPSASGTPGQRVTISCKLNSGNIGSYYVHWYQQLPGTAPKTMIYRDDKRPDGVPDRFSGSSSNSA
SLAISGLQSEDEADYYCHSYDSTITPVFGGGTKLTVL hu107.1x V<sub>H</sub> (SEQ ID NO:71)

EVQLVQSGAEVKKPGSSVKVSCKASDYTFNDYWVSWVRQAPGQGLEWIGEIYPNSGATNFNGKFRGRAT
LTVDNSASTAYMELSSLRSEDTAVYYCTREYTRDWFAYWGQGTLVTVSS hu106.3x V<sub>L</sub> (SEQ ID NO:91)

SVELTQPPSVSVSPGQTARITCKLNSGNIGSYYVHWYQQKPGQAPVTMIYRDDKRPDGIPERFSGSSDSSSNS
AFLTISGVQAEDEADYYCHSYDSTITPVFGGGTKLTVL

*FIG. 7D*

Humanized Anti-4-1BB Antibody Domains
Variable domains (CDRs in bold)

hu107.1y V_H (SEQ ID NO:72)
EVQLVESGGGLVQPGGSLRLSCAASGYTFNDYWVSWVRQAPGKGLEWIGEIYPNSGATNFNGKFRGRATL
SVDNSKNTAYLQMNSLRAEDTAVYYCTREYTRDWFAYWGQGTLVTVSS hu106.4x V_L (SEQ ID NO:92)
EVVLTQPPSLSASPGASARLTCKLNSGNIGSYYVHWYQQKPGSPPRTMIYRDDKRPDGVPSRFSGSKDSSSN
SAFLLISGLQSEDEADYYCHSYDSTITPVFGGGTKLTVL hu106.5x V_L (SEQ ID NO:93)
DVQLTQSPSSLSASVGDRVTITCKLNSGNIGSYYVHWYQQKPGKAPKTMIYRDDKRPDGVPSRFSGSGDSSS
NSAFLTISSLQPEDFATYYCHSYDSTITPVFGQGTKVEIK hu107.1x V_L (SEQ ID NO:94)
DVVLTQSPLSLPVTLGQPASISCRSSQSLLDSDGNTYLYWFQQRPGQSPRRLIYLVSNLGSGVPDRFSGSGSG
TDFTLKISRVEAEDVGVYYCMQPTHAPYTFGQGTKLEIK hu107.1y V_L (SEQ ID NO:95)
DVQLTQSPSSLSASVGDRVTITCRSSQSLLDSDGNTYLYWFQQKPGKAPKRLIYLVSNLGSGVPSRFSGSGS
GTDFTLTISSLQPEDFATYYCMQPTHAPYTFGQGTKVEIK

*FIG. 7E*

Murine Anti-4-1BB Antibody Domains
Variable domains (CDRs in bold)

TABBY1.1 V<sub>H</sub> (SEQ ID NO:73)

EVQLVESGGDLVKPGGSQKLSCAASGFTFSSYGMSWVRQTPDRRLEWVAAIISGGSYTYYPDSVKGRFTIS
RDNAKNTLYLQMNSLKSEDTAMYYCARHGGYDYYAMDYWGQGTSVTVSS

TABBY1.1 V<sub>L</sub> (SEQ ID NO:96)

DVLMTQTPLSLPVSLGDQASISCRSSQSIVDSDGITYLEWYLQKPGQSPKLLIYKVSNRFSGVPDRFSGSGSG
TDFTLRISRVEAEDLGLYYCFQVSHVPWTFGGGTKLEIK

TABBY3 V<sub>H</sub> (SEQ ID NO:74)

GVQLVESGGGLVQPGGSRKLSCAASGFTFSSFGMHWFRQAPEKGLEWVAYISSGSSTIYYADTLKGRFTIS
RDNPKNTLFLQMTSLRSEDTAMYYCARDWVDYWGQGTTLTVSS

TABBY3 V<sub>L</sub> (SEQ ID NO:97)

DIVITQDELSNPVTSGESASISCRSSKSLLYKDGKTYLNWFLQRPGQSPQLLIYLMSTRASGVSDRFTGSGSG
TDFTLEISRVKAEDVGVYYCQQPVEYPYTFGGGTKLEIK

TABBY5 V<sub>H</sub> (SEQ ID NO:75)

EVQLQQSGAELVRPGASVKLSCTASGFNIKDYYMHWVKQRPEQGLEWIGRIDPEDGDTEYVPKFQGKAT
MTADTSSNTAYLQLSSLTSEDTAVYYCTPYSNYVYWYFDVWGTGTTVTSS

TABBY5 V<sub>L</sub> (SEQ ID NO:98)

DVVMTQTPLTLSVTIGQPASISCKSSQSLLLDSDGKTYLNWLLQRPGQSPKRLIYLVSKLDSGVPDRFTGSGSG
TDFTLKISRVEAEDLGVYYCWQGTHFPHTFGGGTKLEIK

*FIG. 7F*

Murine Anti-4-1BB Antibody Domains
Variable domains (CDRs in bold)

TABBY6 V$_H$ (SEQ ID NO:76)
EVQLQQSGAELVRPGASVKLSCTASGFNIKDYYMHWVKQRPEQGLEWIGRIDPEDGDTEYAPKFQGKAT
MTADTSSNTAYLQLSLTSEDTAVYYCTPYSNYVWYFDVWGTGTTVTVSS

TABBY6 V$_L$ (SEQ ID NO:99)
DVVMTQTPLTLSVTIGQAASISCKSSQSLLDSDGKTYLNWLLQRPGQSPKRLIYL**VSKLDSGVPDRFTGSGS
GTDFTLKISRVEAEDLGVYYCWQGTHFPHTFGGGTKLEIK

TABBY9 V$_H$ (SEQ ID NO:77)
QVQLKQSGPGLVQPSQSLSITCTVSGFSLTSYGVHWVRQSPGKGLEWLGMIWSGGSTDYNAAFISRLSISKD
NSKSQVFFKMNSLQADDTALYFCASYGGFYETMDYWGQGTSVTVSS

TABBY9 V$_L$ (SEQ ID NO:100)
DIQMTQTTSSLSASLGDRITISCRASQDISNYLNWYQRKPDGTVKLLIYYTSRLHSGVPSRFSGSGSGRDYSLT
ISNLEQEDIATYFCQQGNTLPYTFGGGTKLEIK

TABBY10 V$_H$ (SEQ ID NO:78)
QIQLVQSGPELKKPGETVKISCKASGYTFTTYGMSWVKQAPGKGLKWMGWINTYSGVPTYADDFKGRFA
FSLETSASTAYLQINNLKNEDTATYFCARGNDGNYYGWFAHWGQGTLVTVSA

TABBY10 V$_L$ (SEQ ID NO:101)
DIQMTQSPSSLSASLGGKVTITCKASQDIHNYISWYQHKPGKGPRLVIHYTSTLQPGIPSRFSGSGSGRDYSFS
ISNLEPEDIATYCLQYDNLYTFGGGTKLEIK

*FIG. 7G*

Anti-CD40 anti-Mesothelin Bispecific Binding Proteins
(CD40 CDRs in bold; mesothelin CDRs in bold underline; constant region in *italics dotted underline*)

LB-1 (SEQ ID NO:400)

EVQLVESGGGLVQPGRSLKLSCAASGFTFSNYDMAWVRQAPTKGLEWVASISPSGGRTYYRDSVKGRFTVSRDNAKS
TLYLQMDSLRSEDTATYYCARHDGSYFDYWGQGVMVTVSSDLSGGGGSGGGGSGGGGSGGGGSTGDTVLTQSPALA
VSPGERVTISCRASESVSTLMHWYQQKPGQOPKLLIYLASHLESGVPARFSGSGSGTDFTLTIDPVEADDTATYYCQES
WNDPWTFGGGTKLELKRLEVPRDSGSKPCICTVPEVSSVFIFPPKDVLTITLTPKVTCVVVDISKDDPEVQFSWFVDDVEV
HTAQTQPREEQFNSTFRSVSELPIMHQDWLNGKEFKCRVNSAAFPAPIEKTISKTKGRPKAPQVYTIPPPKEQMAKDKVSLTCMI
TDFFPEDITVEWQWNGQPAENYKNTQPIMDTDGSYFVYSKLNVQKSNWEAGNTFTCSVLHEGLHNHHTEKSLSHSPGKVDGA
SSPVNVSSPSVQDIQVQLVQSGAEVKKPGASVKVSCKASGYTFTGNYINWVRQAPGQGLEWMGIINPTKGWTLYAQK
FQGRVTMTRDTSISTAYMELSSLRSEDTAVYYCARWHHGTWIFDYWGQGTLVTVSSDLSGGGGSGGGGSGGGGSGG
GGSTGDIVLTQPPSVSGAPGQRVTISCSGSSSNIGSNYVSWYQQLPGTAPKLLIYNDNQRPSGVPDRFSGSKSGTSASLAI
TGLQSEDEADYYCSTYDRRTFSVFGGGTKLTVLG h24 (SEQ ID NO: 401)

EVQLVQSGAEVKEPGASVKVSCKASGDTFNRYYVHWARQAPGQGLEWMGIINPSGVSTTYAQKFQGRVTMTRDTPT
NTVYMELGSLRPEDTAVYFCAESRGSGYNYFAMDVWGQGTLVTVSSDLSGGGGSGGGGSGGGGSTGSYELTQ
PPSVSVSPGQTADITCSGDKLGDKYASWYQQKPGQSPVLVIYQDNRRPSGIPERFSGSNSGNTATLTISGTQAMDEADY
YCQAWDSDTYVFGPGTKVTVLGLEEPKSSDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAKGQPREPQVYTLPPSREE
MTKNQVSLTCLVKGFYPSDIAVEWESNGQPENNYKTTPPVLDSDGSFFLYSKLTVDKSRWQQGNVFSCSVMHEALHNHYTQKS
LSLSPGKVDGASSPVNVSSPVNQIVLQSGAEVKKPGSSVKVSCKASGYTFTSYWMHWVRQAPGQGLEWIGNIDP
SNGETHYNQKFKDRATLTVDKSTSTAYMELSSLRSEDTAVYYCARERIYYSGSTYDGYFDVWGQGTTVTVSSDLSGG
GGSGGGGSGGGGSTEYTLTISSLQPEDFATYYCQQWSSNPWTFGGGTKVEIKR

*FIG. 8A*

Anti-CD40 anti-Mesothelin Bispecific Binding Proteins
(CD40 CDRs in bold; mesothelin CDRs in bold underline; constant region in *italics dotted underline*)

h26 (SEQ ID NO: 402)

EVQLVQSGAEVKEPGASVKVSCKASGDTFNRYYVHWARQAPGQGLEWMGIINPSGVSTTYAQKFQGRVTMTRDTPT
NTVYMELGSLRPEDTAVYFCAESRGSGYNYFAMDVWGQGTLVTVSSDLSGGGGSGGGGSGGGGSTGSYELTQ
PPSVSVSPGQTADITCSGDKLGDKYASWYQQKPGQSPVLVIYQDNRRPSGIPERFSGSNSGNTATLTISGTQAMDEADY
YCQAWDSDTYVFGPGTKVTVLGEEPKSSDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAKGQPREPQVYTLPPSREE
MTKNQVSLTCLVKGFYPSDIAVEWESNGQPENNYKTTPPVLDSDGSFFLYSKLTVDKSRWQQGNVFSCSVMHEALHNHYTQKS
LSLSPGKVDGASSPVNVSSPSVQDIDIQLTQSPSFLSASVGDRVTITCSASSSLSYMHWYQQKPGKSPKRWIYDTSKLASG
VPSRFSGSGSGTEYTLTISSLQPEDFATYYCQQWSSNPWTFGGGTKVEIKRDLSGGGGSGGGGSGGGGSTGEVQ
LVQSGAEVKKPGSSVKVSCKASGYTFTSYWMHWVRQAPGQGLEWIGNIDPSNGETHYNQKFK**DRATLTVDKSTSTA
YMELSSLRSEDTAVYYCARERIYYSGSTYDGYFDVWGQGTTVTVSS

B37 (SEQ ID NO: 403)

EVQLVQSGAEVKKPGSSVKVSCKASGYTFTDYYINWVRQAPGQGLEWIGWIFPGSGSVYCNEQFKGRATLTVDRSTS
TAYMELSSLRSEDTAVFYCASSSLGKFAYWGQGTLVTVSSDLSGGGGSGGGGSGGGGSTGDIQMTQSPSSLSAS
VGDRVTITCKASQSVVTAVAWYQQKPGKSPKLLIYSASNRYTGVPSRFSGSGSGTDFTLTISSLQPEDFATYFC**QQYSSY
PYT**FGGGTKVEIKREPKSSDKTHTCPPCPAPELLGGPSVFLFPPKPKDTLMISRTPEVTCVVVDVSHEDPEEKFNWYVDGVEV
HNAKTKPREEQYNSTYRVVSVLTVLHQDWLNGKEYKCKVSNKALPAPIEKTISKAKGQPREPQVYTLPPSREEMTKNQVSLTCLV
KGFYPSDIAVEWESNGQPENNYKTTPPVLDSDGSFFLYSKLTVDKSRWQQGNVFSCSVMHEALHNHYTQKSLSLSPGKVDGAS
SPVNVSSPSVQDISYELTQPPSVSVSPGQTASITCSGDKLGDKYASWYQQKPGQSPVLVIYQDNRRPSGIPERFSGSNSGN
TATLTISGTQAMDEADYYCQAWDSDTYVFGTGTKVTVLGQDLSGGGGSGGGGSGGGGSTGEVQLVQSGAEV
KKPGASVKVSCKASVRGSGFNYFGMDVWGQGTLVTVSS

*FIG. 8B*

Anti-CD40 anti-Mesothelin Bispecific Binding Proteins
(CD40 CDRs in bold; mesothelin CDRs in bold underline; constant region in *italics dotted underline*)

B38 (SEQ ID NO: 404)

DIQMTQSPSSLSASVGDRVTITCKASQSVVTAVAWYQQKPGKSPKLLIYSASNRYTGVPSRFSGSGSGTDFTLTISSLQPE
DFATYFCQQYSSYPYTFGGGTKVEIKRDLSGGGGSGGGGSGGGGSTGEVQLVQSGAEVKKPGSSVKVSCKASG
YTFTDYYINWVRQAPGQGLEWIGWIFPGSGSVYCNEQFKGRATLTVDRSTSTAYMELSSLRSEDTAVYFCASS**LGKF
AY**WGQGTLVTVSSEPKSSDKTHTCPPCPAPELLGGPSVFLFPPKPKDTLMISRTPEVTCVVVDVSHEDPEEKFNWYVDGVEV
HNAKTKPREEQYNSTYRVVSVLTVLHQDWLNGKEYKCKVSNKALPAPIEKTISKAKGQPREPQVYTLPPSREEMTKNQVSLTCLV
KGFYPSDIAVEWESNGQPENNYKTTPPVLDSDGSFFLYSKLTVDKSRWQQGNVFSCSVMHEALHNHYTQKSLSLSPGKVDGAS
SPVNVSSPSVQDISYELTQPPSVSVSPGQTASITCSGDKLGDKYASWYQQKPGQSPVLVIYQDNRRPSGIPERFSGSNSGN
TATLTISGTQAMDEADYYCQAWDSDTYVFGTGTKVTVLGQDLSGGGGSGGGGSGGGGSGGGGSTGEVQLVQSGAEV
KKPGASVKVSCKASGDTFKRYYVHWVRQAPGQGLEWMGIINPSGVSTTYAQKFQGRVTMTRDTSTSTVYMELSSLR
SEDTAVYYCAEVRGSGFNYFGMDVWGQGTLVTVSS

B39 (SEQ ID NO: 405)

EVQLQESGPGLVKPSETLSLTCTVSGYSITSNYYYWNWIRQPPGKGLEWMGYIRYDGSNNYNPSLKNRVTISRDTSKNQF
SLKLSSVTAADTAVYYCARLDYWGQGTTVTVSSDLSGGGGSGGGGSGGGGSTGDAVMTQTPLSLSVTPGQPA
SISCRSSQSLENTNGNTFLNWYLQKPGQSPQLLIYRVSNRFSGVPDRFSGSGSGTDFTLKISRVEAEDVGVYYC**LQVTH
VPFT**FGQGTKLEIKRVERKSSVECPPCPAPPVAGPSVFLFPPKPKDTLMISRTPEVTCVVVDVSHEDPEVQFNWYVDGVEVHN
AKTKPREEQFNSTFRVVSVLTVVHQDWLNGKEYKCKVSNKGLPAPIEKTISKTKGQPREPQVYTLPPSREEMTKNQVSLTCLVK
GFYPSDIAVEWESNGQPENNYKTTPPMLDSDGSFFLYSKLTVDKSRWQQGNVFSCSVMHEALHNHYTQKSLSLSPGKVDGASS
PVNVSSPSVQDIEVQLVQSGAEVKKPGSSVKVSCKASGDTFKRYYVHWGQGTLVTVSSDLSGGGGSGGGGSGGGGSG
GGGSTGSYELTQPPSVSVSPGQTASITCSGDKLGDKYASWYQQKPGQSPVLVIYQDNRRPSGIPERFSGSNSGNTATLTI
SGTQAMDEADYYCQAWDSDTYVFGTGTKVTVLGQ

FIG. 8C

Anti-CD40 anti-Mesothelin Bispecific Binding Proteins
(CD40 CDRs in bold; mesothelin CDRs in bold underline; constant region in *italics dotted underline*)

B40 (SEQ ID NO: 406)

EVQLQESGPGLVKPSETLSLTCTVSGYSITSNYYWNWIRQPPGKGLEWMGYIRYDGSNNYNPSLKNRVTISRDTSKNQF
SLKLSSVTAADTAVYYCARLDYWGQGTTVTVSSDLSGGGGSGGGGSGGGGSGGGGSTDFTLKISRVEAEDVGVYYCLQVTH
VPFTFGOGTKLEIKRLEEPKSSDKTHTCPPCPAPELLGGPSVFLFPPKPKDTLMISRTPEVTCVVVDVSHEDPEEKFNWYVDG
*VEVHNAKTKPREEQYNSTYRVVSVLTVLHQDWLNGKEYKCKVSNKALPAPIEKTISKAKGQPREPQVYTLPPSREEMTKNQVSLT*
*CLVKGFYPSDIAVEWESNGQPENNYKTTPPVLDSDGSFFLYSKLTVDKSRWQQGNVFSCSVMHEALHNHYTQKSLSLSPGKVD*
GASSPVNVSSPSVQDISYELTQPPSVSVSPGQTASITCSGDKLGDKYASWYQQKPGQSPVLVIYQDNRRPSGIPERFSGSN
SGNTATLTISGTQAMDEADYYCQAWDSDTYVFGTGTKVTVLGQDLSGGGGSGGGGSGGGGSTGEVQLVQSG
AEVKKPGASVKVSCKASGDTFKRYYVHWVRQAPGQGLEWMGIINPSGVSTTYAQKFQGRVTMTRDTSTSTVYMELS
SLRSEDTAVYYCAEVRGSGFNYFGMDVWGQGTLVTVSS

B41 (SEQ ID NO: 407)

DAVMTQTPLSLSVTPGQPASISCRSSQSLENTNGNTFLNWYLQKPGQSPQLLIYRVSNRFSGVPDRFSGSGSGTDFTLKI
SRVEAEDVGVYYCLQVTHVPFTFGQGTKLEIKRDLSGGGGSGGGGSGGGGSGGGGSPGLVKPSETLSL
TCTVSGYSITSNYYWNWIRQPPGKGLEWMGYIRYDGSNNYNPSLKNRVTISRDTSKNQFSLKLSSVTAADTAVYYCAR
LDYWGQGTTVTVSSREPKSSDKTHTCPPCPAPELLGGPSVFLFPPKPKDTLMISRTPEVTCVVVDVSHEDPEEKFNWYVDGV
*EVHNAKTKPREEQYNSTYRVVSVLTVLHQDWLNGKEYKCKVSNKALPAPIEKTISKAKGQPREPQVYTLPPSREEMTKNQVSLTC*
*LVKGFYPSDIAVEWESNGQPENNYKTTPPVLDSDGSFFLYSKLTVDKSRWQQGNVFSCSVMHEALHNHYTQKSLSLSPGKVD*
ASSPVNVSSPSVQDIEVQLVQSGAEVKKPGASVKVSCKASGDTFKRYYVHWVRQAPGQGLEWMGIINPSGVSTTYYAQ
KFQGRVTMTRDTSTSTVYMELSSLRSEDTAVYYCAEVRGSGFNYFGMDVWGQGTLVTVSSDLSGGGGSGGGGSGGG
GSGGGGSGSYELTQPPSVSVSPGQTASITCSGDKLGDKYASWYQQKPGQSPVLVIYQDNRRPSGIPERFSGSNSGNTAT
LTISGTQAMDEADYYCQAWDSDTYVFGTGTKVTVLGQ

FIG. 8D

Anti-CD40 anti-Mesothelin Bispecific Binding Proteins
(CD40 CDRs in bold; mesothelin CDRs in bold underline; constant region in *italics dotted underline*)

B42 (SEQ ID NO: 408)

DAVMTQTPLSLSVTPGQPASISCRSSQSLENTNGNTFLNWYLQKPGQSPQLLIYRVSNRFSGVPDRFSGSGSGTDFTLKI
SRVEAEDVGVYYCLQVTHVPFTFGQGTKLEIKRDLSGGGGSGGGGSGGGGSTGEVQLQESGPGLVKPSETLSL
TCTVSGYSITSNYYWNWIRQPPGKGLEWMGYIRYDGSNNYNPSLKNRVTISRDTSKNQFSLKLSSVTAADTAVYYCAR
LDYWGQGTTVTSSREPKSSDKTHTCPPCPAPELLGGPSVFLFPPKPKDTLMISRTPEVTCVVVDVSHEDPEEKFNWYVDGV
EVHNAKTKPREEQYNSTYRVVSVLTVLHQDWLNGKEYKCKVSNKALPAPIEKTISKAKGQPREPQVYTLPPSREEMTKNQVSLTC
LVKGFYPSDIAVEWESNGQPENNYKTTPPVLDSDGSFFLYSKLTVDKSRWQQGNVFSCSVMHEALHNHYTQKSLSLSPGKVDG
ASSPVNVSSPSVQDISYELTQPPSVSVSPGQTASITCSGDKLGDKYASWYQQKPGQSPVLVIYQDNRRPSGIPERFSGSNS
GNTATLTISGTQAMDEADYYCQAWDSDTYVFGTGTKVTVLGQDLSGGGGSGGGGSGGGGSTGEVQLVQSGA
EVKKPGASVKVSCKASGDTFKRYYVHWVRQAPGQGLEWMGIINPSGVSTTYAQKFQGRVTMTRDTSTSTVYMELSS
LRSEDTAVYYCAEVRGSGFNYFGMDVWGQGTLVTVSS

B43 (SEQ ID NO: 409)

EVQLVQSGAEVKKPGASVKVSCKASGDTFKRYYVHWVRQAPGQGLEWMGIINPSGVSTTYAQKFQGRVTMTRDTST
STVYMELSSLRSEDTAVYYCAEVRGSGFNYFGMDVWGQGTLVTVSSDLSGGGGSGGGGSGGGGSTGSYELTQ
PPSVSVSPGQTASITCSGDKLGDKYASWYQQKPGQSPVLVIYQDNRRPSGIPERFSGSNSGNTATLTISGTQAMDEADY
YCQAWDSDTYVFGTGTKVTVLGQEPKSSDKTHTCPPCPAPELLGGPSVFLFPPKPKDTLMISRTPEVTCVVVDVSHEDPEE
KFNWYVDGVEVHNAKTKPREEQYNSTYRVVSVLTVLHQDWLNGKEYKCKVSNKALPAPIEKTISKAKGQPREPQVYTLPPSREE
MTKNQVSLTCLVKGFYPSDIAVEWESNGQPENNYKTTPPVLDSDGSFFLYSKLTVDKSRWQQGNVFSCSVMHEALHNHYTQKS
LSLSPGKVDGASSPVNVSSPSVQDIDIQMTQSPSSLSASVGDRVTITCKASQSVVTAVAWYQQKPGKSPKLLIYSASNRYT
GVPSRFSGSGSGTDFTLTISSLQPEDFATYFCQQYSSYPYTFGGGTKVEIKRDLSGGGGSGGGGSGGGGSTGEVQ
LVQSGAEVKKPGSSVKVSCKASGGTFTDYYINWVRQAPGQGLEWIGWIFPGSGSVYCNEQFKGRATLTVDRSTSTAY
MELSSLRSEDTAVYFCASSLGKFAYWGQGTLVTVSS

*FIG. 8E*

Anti-CD40 anti-Mesothelin Bispecific Binding Proteins
(CD40 CDRs in bold; mesothelin CDRs in bold underline; constant region in *italics dotted underline*)

B44 (SEQ ID NO: 410)

SYELTQPPSVSVSPGQTASITCSGDKLGDKYASWYQQKPGQSPVLVIYQDNRRPSGIPERFSGSNSGNTATLTISGTQAM
DEADYCQAWDSDTYVFGTGTKVTVLGQDLSGGGGSGGGGSTGEVQLVQSGAEVKKPGASVKVSCK
ASGDTFKRYYVHWVRQAPGQGLEWMGIINPSGVSTTYAQKFQGRVTMTRDTSTSTVYMELSSLRSEDTAVYYCAEV
RGSGFNYFGMDVWGQGTLVTVSS*EPKSSDKTHTCPPCPAPELLGGPSVFLFPPKPKDTLMISRTPEVTCVVVDVSHEDPEE*
*KFNWYVDGVEVHNAKTKPREEQYNSTYRVVSVLTVLHQDWLNGKEYKCKVSNKALPAPIEKTISKAKGQPREPQVYTLPPSREE*
*MTKNQVSLTCLVKGFYPSDIAVEWESNGQPENNYKTTPPVLDSDGSFFLYSKLTVDKSRWQQGNVFSCSVMHEALHNHYTQKS*
*LSLSPGK*VDGASSPVNVSSPVQDIEVQLVQSGAEVKKPGSSVKVSCKASGYTFTDYYINWVRQAPGQGLEWIG**WIFPG
SGSVYCNEQFKGRATLTVDRSTSTAYMELSSLRSEDTAVYFCASSLGKFAY**WGQGTLVTVSSDLSGGGGSGGGGSGG
GGSGGGGSTGDIQMTQSPSSLSASVGDRVTITCKASQSVVTAVAWYQQKPGKSPKLLIYSASNRYTGVPSRFSGSGSGT
DFTLTISSLQPEDFATYFCQQYSSYPYTFGGGTKVEIKR

B45 (SEQ ID NO: 411)

SYELTQPPSVSVSPGQTASITCSGDKLGDKYASWYQQKPGQSPVLVIYQDNRRPSGIPERFSGSNSGNTATLTISGTQAM
DEADYCQAWDSDTYVFGTGTKVTVLGQDLSGGGGSGGGGSTGEVQLVQSGAEVKKPGASVKVSCK
ASGDTFKRYYVHWVRQAPGQGLEWMGIINPSGVSTTYAQKFQGRVTMTRDTSTSTVYMELSSLRSEDTAVYYCAEV
RGSGFNYFGMDVWGQGTLVTVSS*EPKSSDKTHTCPPCPAPELLGGPSVFLFPPKPKDTLMISRTPEVTCVVVDVSHEDPEE*
*KFNWYVDGVEVHNAKTKPREEQYNSTYRVVSVLTVLHQDWLNGKEYKCKVSNKALPAPIEKTISKAKGQPREPQVYTLPPSREE*
*MTKNQVSLTCLVKGFYPSDIAVEWESNGQPENNYKTTPPVLDSDGSFFLYSKLTVDKSRWQQGNVFSCSVMHEALHNHYTQKS*
*LSLSPGK*VDGASSPVNVSSPSVQDIDIQMTQSPSSLSASVGDRVTITCKASQSVVTAVAWYQQKPGKSPKLLIYSASNRYT
GVPSRFSGSGSGTDFTLTISSLQPEDFATYFCQQYSSYPYTFGGGTKVEIKRDLSGGGGSGGGGSGGGGSTGEVQ
LVQSGAEVKKPGSSVKVSCKASGYTFTDYYINWVRQAPGQGLEWIGWIFPGSGSVYCNEQFKGRATLTVDRSTSTAY
MELSSLRSEDTAVYFCASSLGKFAYWGQGTLVTVSS

*FIG. 8F*

Anti-CD40 anti-Mesothelin Bispecific Binding Proteins
(CD40 CDRs in bold; mesothelin CDRs in bold underline; constant region in *italics dotted underline*)

B46 (SEQ ID NO: 412)

SYELTQPPSVSVSPGQTASITCSGDKLGDKYASWYQQKPGQSPVLVIYQDNRRPSGIPERFSGSNSGNTATLTISGTQAM
DEADYYCQAWDSDTYFGTGTKVTVLGQDLSGGGGSGGGGSGGGGSTGEVQLVQSGAEVKKPGASVKVSCK
ASGDTFKRYYVHWVRQAPGQGLEWMGIINPSGVSTTYAQKFQGRVTMTRDTSTSTVYMELSSLRSEDTAVYYCAEV
RGSGFNYFGMDVWGQGTLVTVSSEPKSSDKTHTCPPCPAPELLGGPSVFLFPPKPKDTLMISRTPEVTCVVVDVSHEDPEE
KFNWYVDGVEVHNAKTKPREEQYNSTYRVVSVLTVLHQDWLNGKEYKCKVSNKALPAPIEKTISKAKGQPREPQVYTLPPSREE
MTKNQVSLTCLVKGFYPSDIAVEWESNGQPENNYKTTPPVLDSDGSFFLYSKLTVDKSRWQQGNVFSCSVMHEALHNHYTQKS
LSLSPGKVDGASSPVNVSSPSVQDIEVQLQESGPGLVKPSETLSLTCTVSGYSITSNYYWNWIRQPPGKGLEWMG**YIRYD
GSNNYNPSLKNRVTISRDTSKNQFSLKLSSVTPGQPASISCRSSQSLENTNGNTFLNWYLQKPGQSPQLLIYRVSNRFS**GVPDRFSGSGSGTD
FTLKISRVEAEDVGVYYCLQVTHVPFTFGQGTKLEIKR

V6-2 (SEQ ID NO:419)

EVQLQESGPGLVKPSETLSLTCTVSGYSITSNYYWNWIRQPPGKGLEWMGYIRYDGSNNYNPSLKNRVTISRDTSKNQF
SLKLSSVTAADTAVYYCARLDYWGQGTTVTVSSGGGGSGGGGSGGGGSDAVMTQTPLSLSVT
PGQPASISCRSSQSLENTNGNTFLNWYLQKPGQSPQLLIYRVSNRFSGVPDRFSGSGSGTDFTLKISRVEAEDVGVYYCL
QVTHVPFTFGQGTKLEIKREPKSSDKTHTCPPCPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIEKTISKAKGQPREPQVYTLPPSREEMTKNQV
SLTCLVKGFYPSDIAVEWESNGQPENNYKTTPPVLDSDGSFFLYSKLTVDKSRWQQGNVFSCSVMHEALHNHYTQKSLSLSPGK
GGGSGGGGSGGGGSGGGGSSYELTQPPSVSVAPGQTARISCSGDKLGDKYASWYQQKPGQAPVLVIYQDNRRPSGIPER
FSGSNSGNTATLTISGTQAEDEADYYCQAWDSDTYFGGGTKLTVLGQGGSGGGGSGGGGSGGGGSGGGGG
SEVQLVQSGAEVKKPGASVKVSCKASGDTFKRYYVHWVRQAPGQGLEWMGIINPSGVSTTYAQKFQGRVTMTRDTS
TSTVYMELSSLRSEDTAVYYCAEVRGSGFNYFGMDVWGQGTLVTVSS

*FIG. 8G*

Anti-CD40 anti-Mesothelin Bispecific Binding Proteins
(CD40 CDRs in bold; mesothelin CDRs in bold underline; constant region in *italics dotted underline*)

V6-5 (SEQ ID NO:420)

EVQLQESGPGLVKPSETLSLTCTVSGYSITSNYYWNWIRQPPGKGLEWMGYIRYDGSNNYNPSLKNRVTISRDTSKNQF
SLKLSSVTAADTAVYYCARLDYWGQGTTVTVSSGGGGSGGGGSGGGGSGGGGSDAQMTQSPSSLSAS
VGDRVTITCRSSQSLENTNGNTFLNWFQQKPGKAPKLLIYRVSNRFSGVPSRFSGSGSGTDFTLTISSLQPEDFATYYCL
QVTHVPFTFGQGTKLEIKREPKSSDKTHTCPPCPAPELLGGPSVFLFPPKPKDTLMISRTPEVTCVVVDVSHEDPEEKFNWYV
DGVEVHNAKTKPREEQYNSTYRVVSVLTVLHQDWLNGKEYKCKVSNKALPAPIEKTISKAKGQPREPQVYTLPPSREEMTKNQV
SLTCLVKGFYPSDIAVEWESNGQPENNYKTTPPVLDSDGSFFLYSKLTVDKSRWQQGNVFSCSVMHEALHNHYTQKSLSLSPGK
GGGGSGGGGSGGGGSGGGGSSYELTQPPSVSVAPGQTARISCSGDKLGDKYASWYQQKPGQAPVLVIYQDNRRPSGIPER
FSGSNSGNTATLTISGTQAEDEADYYCQAWDSDTYVFGGGTKLTVLGQGGGSGGGGSGGGGSGGGGSGGGGSGGGG
SEVQLVQSGAEVKKPGASVKVSCKASGDTFKRYYVHWVRQAPGQGLEWMGIINPSGVSTTYAQKFQGRVTMTRDTS
TSTVYMELSSLRSEDTAVYYCAEVRGSGFNYFGMDVWGQGTLVTVSS

V6-6 (SEQ ID NO:421)

EVQLQESGPGLVKPSETLSLTCTVSGYSITSNYYWNWIRQPPGKGLEWMGYIRYDGSNNYNPSLKNRVTISRDTSKNQF
SLKLSSVTAADTAVYYCARLDYWGQGTTVTVSSGGGGSGGGGSGGGGSGGGGSDAQMTQSPSSLSAS
VGDRVTITCRSSQSLENTNGNTFLNWFQQKPGKAPKLLIYRVSNRFSGVPSRFSGSGSGTDFTLTISSLQPEDFATYYCL
QVTHVPFTFGQGTKLEIKREPKSSDKTHTCPPCPAPELLGGPSVFLFPPKPKDTLMISRTPEVTCVLVDVSHEDPEVKFNWYV
DGVEVHNAKTKPREEQYNSTYRVVSVLTVLHQDWLNGKEYKCKVSNKALPAPIEKTISKAKGQPREPQVYTLPPSREEMTKNQV
SLTCLVKGFYPSDIAVEWESNGQPENNYKTTPPVLDSDGSFFLYSKLTVDKSRWQQGNVFSCSVMHEALHNHYTQKSLSLSPGK
GGGGSGGGGSGGGGSGGGGSSYELTQPPSVSVAPGQTARISCSGDKLGDKYASWYQQKPGQAPVLVIYQDNRRPSGIPER
FSGSNSGNTATLTISGTQAEDEADYYCQAWDSDTYVFGGGTKLTVLGQGGGSGGGGSGGGGSGGGGSGGGGSGGGG
SEVQLVQSGAEVKKPGASVKVSCKASGDTFKRYYVHWVRQAPGQGLEWMGIINPSGVSTTYAQKFQGRVTMTRDTS
TSTVYMELSSLRSEDTAVYYCAEVRGSGFNYFGMDVWGQGTLVTVSS

*FIG. 8H*

Anti-4-1BB anti-Mesothelin Bispecific Binding Proteins
(4-1BB CDRs in bold; mesothelin CDRs in bold underline; constant region in *italics dotted underline*)

hu106MSLN-1 (SEQ ID NO:431)

EVQLVQSGAEVKKPGSSVKVSCKASGYTFTSYYIYWVRQAPGQGLEWIGNIWPGNGGTFYGEKFMGRATFTADTSTS
TAYMELSSLRSEDTAVYYCARRPDYSGDDYFDYWGQGTLVTVSSGGGGSGGGGSGGGGSGGGGSGGGGSNV
MLTQPHSVSESPGKTVTISCKLNSGNIGSYYVHWYQQRPGSSPTTMIYRDDKRPDGVPDRFSGSIDSSSNSASLTISGLKT
EDEADYCHSYDSTITPVFGGGTKLTVLGQEPKSSDKTHTCPPCPAPELLGGPSVFLFPPKPKDTLMISRTPEVTCVVVDVS
HEDPEEKFNWYVDGVEVHNAKTKPREEQYNSTYRVVSVLTVLHQDWLNGKEYKCKVSNKALPAPIEKTISKAKGQPREPQVYTL
PPSREEMTKNQVSLTCLVKGFYPSDIAVEWESNGQPENNYKTTPPVLDSDGSFFLYSKLTVDKSRWQQGNVFSCSVMHEALHN
HYTQKSLSLSPGKGGGGSGGGGSGGGGSSGIPERFSGSNSGNTATLTISGTQAMDEADYYCQAWDSDTYVFGTGTKVTVLGQGGGSGGGGSGGGGSGG
QDNRRPSGIPERFSGSNSGNTATLTISGTQAMDEADYYCQAWDSDTYVFGTGTKVTVLGQGGGSGGGGSGGGGSGG
GGSGGGGSGGGGSEVQLVQSGAEVKKPGASVKVSCKASGDTFKRYYVHWVRQAPGQGLEWMGIINPSGVSTTYAQK
FQGR*VTMTRDTSTSTVYMELSSLRSEDTAVYYCAEVRGSGFNYFGMDVWGQGTLVTVSS* hu106MSLN-2 (SEQ ID NO:432)

NVMLTQPHSVSESPGKTVTISCKLNSGNIGSYYVHWYQQRPGSSPTTMIYRDDKRPDGVPDRFSGSIDSSSNSASLTISG
LKTEDEADYCHSYDSTITPVFGGGTKLTVLGQGGGSGGGGSGGGGSGGGGSEVQLVQSGAEVKKP
GSSVKVSCKASGYTFTSYYIYWVRQAPGQGLEWIGNIWPGNGGTFYGEKFMGRATFTADTSTSTAYMELSSLRSEDT
AVYYCARRPDYSGDDYFDYWGQGTLVTVSSEPKSSDKTHTCPPCPAPELLGGPSVFLFPPKPKDTLMISRTPEVTCVVVDV
SHEDPEEKFNWYVDGVEVHNAKTKPREEQYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKLTVDKSRWQQGNVFSCSVMHEALHN
HYTQKSLSLSPGKGGGGSGGGGSGGGGSSGGGGSEVQLVQSGAEVKKPGASVKVSCKASGDTFKRYYVHWVRQAPGQGLEWMGIINPSGVSTTYAQK
QDNRRPSGIPERFSGSNSGNTATLTISGTQAMDEADYYCQAWDSDTYVFGTGTKVTVLGQGGGSGGGGSGGGGSGG
GGSGGGGSGGGGSEVQLVQSGAEVKKPGASVKVSCKASGDTFKRYYVHWVRQAPGQGLEWMGIINPSGVSTTYAQK
FQGR*VTMTRDTSTSTVYMELSSLRSEDTAVYYCAEVRGSGFNYFGMDVWGQGTLVTVSS*

*FIG. 8I*

Anti-4-1BB anti-Mesothelin Bispecific Binding Proteins
(4-1BB CDRs in bold; mesothelin CDRs in bold underline; constant region in *italics dotted underline*)

hu106MSLN-3 (SEQ ID NO:433)

SYELTQPPSVSVSPGQTASITCSGDKLGDKYASWYQQKPGQSPVLVIYQDNRRPSGIPERFSGSNSGNTATLTISGTQAM
DEADYYCQAWDSDTYFGTGTKVTVLGQGGSGGGSGGGSGGGSEVQLVQSGAEVKKPGAS
VKVSCKASGDTFKRYYVHWVRQAPGQGLEWMGIINPSGVSTTYAQKFQGRVTMTRDTSTSTVYMELSSLRSEDTAV
YYCAEVRGSSGFNYFGMDVWGQGTLVTVSS*EPKSSDKTHTCPPCPAPELLGGPSVFLFPPKPKDTLMISRTPEVTCVVVDVS
HEDPEEKFNWYVDGVEVHNAKTKPREEQYNSTYRVVSVLTVLHQDWLNGKEYKCKVSNKALPAPIEKTISKAKGQPREPQVYTL
PPSREEMTKNQVSLTCLVKGFYPSDIAVEWESNGQPENNYKTTPPVLDSDGSFFLYSKLTVDKSRWQQGNVFSCSVMHEALHN
HYTQKSLSLSPGK*GGGGSGGGGSGGGGSGGGGSEVQLVQSGAEVKKPGSSVKVSCKASGYTFTSYYIYWVRQAPGQGLEW
IGNIWPGNGGTFYGEKFMGRATFTADTSTSTAYMELSSLRSEDTAVYYCARRPDYSGDDYFDYWGQGTLVTVSSGG
GGSGGGGSGGGGSGGGGSSIDSSSNSASLTISGLKTEDEADYYCHSYDSTITPVFGGGTKLTVLGQ hu106MSLN-4 (SEQ ID NO:434)

SYELTQPPSVSVSPGQTASITCSGDKLGDKYASWYQQKPGQSPVLVIYQDNRRPSGIPERFSGSNSGNTATLTISGTQAM
DEADYYCQAWDSDTYFGTGTKVTVLGQGGSGGGSGGGSGGGSEVQLVQSGAEVKKPGAS
VKVSCKASGDTFKRYYVHWVRQAPGQGLEWMGIINPSGVSTTYAQKFQGRVTMTRDTSTSTVYMELSSLRSEDTAV
YYCAEVRGSSGFNYFGMDVWGQGTLVTVSS*EPKSSDKTHTCPPCPAPELLGGPSVFLFPPKPKDTLMISRTPEVTCVVVDVS
HEDPEEKFNWYVDGVEVHNAKTKPREEQYNSTYRVVSVLTVLHQDWLNGKEYKCKVSNKALPAPIEKTISKAKGQPREPQVYTL
PPSREEMTKNQVSLTCLVKGFYPSDIAVEWESNGQPENNYKTTPPVLDSDGSFFLYSKLTVDKSRWQQGNVFSCSVMHEALHN
HYTQKSLSLSPGK*GGGGSGGGGSGGGGSEVQLVQSGAEVKKPGSSVKVSCKASGYTFTSYYIHWVRQAPGQGLEWIGNIWPGNGGTFYG
YRDDKRPDGVPDRFSGSIDSSSNSASLTISGLKTEDEADYYCHSYDSTITPVFGGGTKLTVLGQGGSGGGGSGGGGS
GGGGSGGGGSEVQLVQSGAEVKKPGSSVKVSCKASGYTFTSYYIYWVRQAPGQGLEWIGNIWPGNGGTFYG
EKFMGRATFTADTSTSTAYMELSSLRSEDTAVYYCARRPDYSGDDYFDYWGQGTLVTVSS

Anti-4-1BB anti-Mesothelin Bispecific Binding Proteins
(4-1BB CDRs in bold; mesothelin CDRs in bold underline; constant region in *italics dotted underline*)

hu106MSLN-5 (SEQ ID NO:435)

EVQLVQSGAEVKKPGSSVKVSCKASGYTFTSYYIYWVRQAPGQGLEWIGN**IWPGNGGTFYGEKF
MGRATFTADTSTSTAYMELSSLRSEDTAVYYCARRPDYSGDDYFDY**WGQGTLVTVSSGGGGSGG
GGSGGGGSGGGGSGGGGSNVMLTQPHSVSESPGKTVTISCKLNSGNIGSYYVHWYQQRP
GSSPTTMIYRDDKRPDGVPDRFSGSIDSSSNSASLTISGLKTEDEADYYCHSYDSTITPVFGGGTKLT
VLGQERKCCVECPPCPAPPAAAPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTKGQPREPQVYTLPPS
REEMTKNQVSLTCLVKGFYPSDIAVEWESNGQPENNYKTTPPMLDSDGSFFLYSKLTVDKSRWQQGNVF
SCSVMHEALHNHYTQKSLSLSPGKGGGGSGGGGSGGGGSYELTQPPSVSVSPGQTASITC**SGDK
LGDKYASWYQQKPGQSPVLVIYQDNRRPSGIPERFSGSNSGNTATLTISGTQAMDEADYYCQAW
DSDTYV**FGTGTKVTLGQGGGSGGGGSGGGGSQVQLVQSGAEVKKPG
ASVKVSCKASGDTFKRYYVHWVRQAPGQGLEWMGIINPSGVSTTYAQKFQGRVTMTRDTSTST
VYMELSSLRSEDTAVYYCAEVRGSGFNYFGMDVWGQGTLVTVSS hu106MSLN-6 (SEQ ID NO:436)

EVQLVQSGAEVKKPGSSVKVSCKASGYTFTSYYIYWVRQAPGQGLEWIGN**IWPGNGGTFYGEKF
MGRATFTADTSTSTAYMELSSLRSEDTAVYYCARRPDYSGDDYFDY**WGQGTLVTVSSGGGGSGG
GGSGGGGSGGGGSGGGGSNVMLTQPHSVSESPGKTVTISCKLNSGNIGSYYVHWYQQRP
GSSPTTMIYRDDKRPDGVPDRFSGSIDSSSNSASLTISGLKTEDEADYYCHSYDSTITPVFGGGTKLT
VLGQERKSSVECPPCPAPPAAAPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTKGQPREPQVYTLPPS
REEMTKNQVSLTCLVKGFYPSDIAVEWESNGQPENNYKTTPPMLDSDGSFFLYSKLTVDKSRWQQGNVF
SCSVMHEALHNHYTQKSLSLSPGKGGGGSGGGGSGGGGSYELTQPPSVSVSPGQTASITC**SGDK
LGDKYASWYQQKPGQSPVLVIYQDNRRPSGIPERFSGSNSGNTATLTISGTQAMDEADYYCQAW
DSDTYV**FGTGTKVTLGQGGGSGGGGSGGGGSQVQLVQSGAEVKKPG
ASVKVSCKASGDTFKRYYVHWVRQAPGQGLEWMGIINPSGVSTTYAQKFQGRVTMTRDTSTST
VYMELSSLRSEDTAVYYCAEVRGSGFNYFGMDVWGQGTLVTVSS

Anti-4-1BB anti-Mesothelin Bispecific Binding Proteins
(4-1BB CDRs in bold; mesothelin CDRs in bold underline; constant region in *italics dotted underline*)

hu107MSLN-1 (SEQ ID NO:437)

EVQLVQSGAEVKKPGSSVKVSCKASDYTFNDYWVSWVRQAPGQGLEWIGEIYPNSGATNFNGKFRGRATLTVDNSA
STAYMELSSLRSEDTAVYYCTRETRDWFAYWGQGTLVTVSSGGGGSGGGGSGGGGSGGGGSDVVL
TQSPLSLPVTLGQPASISCRSSQSLLDSDGNTYLYWFQQRPGQSPRRLIYLVSNLGSGVPDRFSGSGSGTDFTLKISRVEA
EDVGVYYCMQPTHAPYTFGQGTKLEIKREPKSSDKTHTCPPCPAPELLGGPSVFLFPPKPKDTLMISRTPEVTCVVVDVSHE
DPEEKFNWYVDGVEVHNAKTKPREEQYNSTYRVVSVLTVLHQDWLNGKEYKCKVSNKALPAPIEKTISKAKGQPREPQVYTLPP
SREEMTKNQVSLTCLVKGFYPSDIAVEWESNGQPENNYKTTPPVLDSDGSFFLYSKLTVDKSRWQQGNVFSCSVMHEALHNHY
TQKSLSLSPGKGGGGSGGGGSGGGGSGGGGSYELTQPPSVSVSPGQTASITCSGDKLGDKYASWYQQKPGQSPVLVIYQD
NRRPSGIPERFSGSNSGNTATLTISGTQAMDEADYYCQAWDSDTFKRYYVHWVRQAPGQGLEWMGIINPSGVSTTYAQKFQ
SGGGGSGGGGSEVQLVQSGAEVQLVQSGAEVKKPGASVKVSCKASGDTFKRYYVHWVRQAPGQGLEWMGIINPSGVSTTYAQKFQ
GRVTMTRDTSTSTVYMELSSLRSEDTAVYYCAEVRGSGFNYFGMDVWGQGTLVTVSS hu107MSLN-2 (SEQ ID NO:438)

DVVLTQSPLSLPVTLGQPASISCRSSQSLLDSDGNTYLYWFQQRPGQSPRRLIYLVSNLGSGVPDRFSGSGSGTDFTLKIS
RVEAEDVGVYYCMQPTHAPYTFGQGTKLEIKRGGGGSGGGGSGGGGSGGGGSEVQLVQSGAEVKKP
GSSVKVSCKASDYTFNDYWVSWVRQAPGQGLEWIGEIYPNSGATNFNGKFRGRATLTVDNSASTAYMELSSLRSEDT
AVYYCTRETRDWFAYWGQGTLVTVSSEPKSSDKTHTCPPCPAPELLGGPSVFLFPPKPKDTLMISRTPEVTCVVVDVSHE
DPEEKFNWYVDGVEVHNAKTKPREEQYNSTYRVVSVLTVLHQDWLNGKEYKCKVSNKALPAPIEKTISKAKGQPREPQVYTLPP
SREEMTKNQVSLTCLVKGFYPSDIAVEWESNGQPENNYKTTPPVLDSDGSFFLYSKLTVDKSRWQQGNVFSCSVMHEALHNHY
TQKSLSLSPGKGGGGSGGGGSGGGGSGGGGSYELTQPPSVSVSPGQTASITCSGDKLGDKYASWYQQKPGQSPVLVIYQD
NRRPSGIPERFSGSNSGNTATLTISGTQAMDEADYYCQAWDSDTFKRYYVHWVRQAPGQGLEWMGIINPSGVSTTYAQKFQ
SGGGGSGGGGSEVQLVQSGAEVQLVQSGAEVKKPGASVKVSCKASGDTFKRYYVHWVRQAPGQGLEWMGIINPSGVSTTYAQKFQ
GRVTMTRDTSTSTVYMELSSLRSEDTAVYYCAEVRGSGFNYFGMDVWGQGTLVTVSS

*FIG. 8L*

Anti-4-1BB anti-Mesothelin Bispecific Binding Proteins
(4-1BB CDRs in bold underline; mesothelin CDRs in bold; constant region in *italics dotted underline*)

hu107MSLN-3 (SEQ ID NO:439)

SYELTQPPSVSVSPGQTASITCSGDKLGDKYASWYQQKPGQSPVLVIYQDNRRPSGIPERFSGSNSGNTATLTISGTQAM
DEADYYCQAWDSDTYVFGTGTKVTLGQGGSGGGGSGGGGSGGGGSEVQLVQSGAEVKKPGAS
VKVSCKASGDTFKRYYVHWVRQAPGQGLEWMGIINPSGVSTTYAQKFQGRVTMTRDTSTSTVYMELSSLRSEDTAV
YYCAEVRGSGFNYFGMDVWGQGTLVTVSS*EPKSSDKTHTCPPCPAPELLGGPSVFLFPPKPKDTLMISRTPEVTCVVVDVS
HEDPEEKFNWYVDGVEVHNAKTKPREEQYNSTYRVVSVLTVLHQDWLNGKEYKCKVSNKALPAPIEKTISKAKGQPREPQVYTL
PPSREEMTKNQVSLTCLVKGFYPSDIAVEWESNGQPENNYKTTPPVLDSDGSFFLYSKLTVDKSRWQQGNVFSCSVMHEALHN
HYTQKSLSLSPGK*GGGSGGGGSGGGGSGGGGSEVQLVQSGAEVKKPGSSVKVSCKASDYTFNDYWVSWVRQAPGQGLE
WIGEIYPNSGATNFNGKFRGRATLTVDNSASTAYMELSSLRSEDTAVYYCTREYTRDWFAYWGQGTLVTVSSGGGGS
GGGGSGGGGSGGGGSDVVLTQSPLSLPVTLGQPASISCRSSQSLLLDSDGNTYLYWFQQRPGQSPRRLIY
LVSNLGSGVPDRFSGSGSGTDFTLKISRVEAEDVGVYYCMQPTHAPYTFGQGTKLEIKR hu107MSLN-4 (SEQ ID NO:440)

SYELTQPPSVSVSPGQTASITCSGDKLGDKYASWYQQKPGQSPVLVIYQDNRRPSGIPERFSGSNSGNTATLTISGTQAM
DEADYYCQAWDSDTYVFGTGTKVTLGQGGSGGGGSGGGGSGGGGSEVQLVQSGAEVKKPGAS
VKVSCKASGDTFKRYYVHWVRQAPGQGLEWMGIINPSGVSTTYAQKFQGRVTMTRDTSTSTVYMELSSLRSEDTAV
YYCAEVRGSGFNYFGMDVWGQGTLVTVSS*EPKSSDKTHTCPPCPAPELLGGPSVFLFPPKPKDTLMISRTPEVTCVVVDVS
HEDPEEKFNWYVDGVEVHNAKTKPREEQYNSTYRVVSVLTVLHQDWLNGKEYKCKVSNKALPAPIEKTISKAKGQPREPQVYTL
PPSREEMTKNQVSLTCLVKGFYPSDIAVEWESNGQPENNYKTTPPVLDSDGSFFLYSKLTVDKSRWQQGNVFSCSVMHEALHN
HYTQKSLSLSPGK*GGGSGGGGSDVVLTQSPLSLPVTLGQPASISCRSSQSLLLDSDGNTYLYWFQQRPGQSP
RRLIYLVSNLGSGVPDRFSGSGSGTDFTLKISRVEAEDVGVYYCMQPTHAPYTFGQGTKLEIKRGGGGSGGGGSGGGGG
SGGGGSEVQLVQSGAEVKKPGSSVKVSCKASDYTFNDYWVSWVRQAPGQGLEWIGEIYPNSGATNF
NGKFRGRATLTVDNSASTAYMELSSLRSEDTAVYYCTREYTRDWFAYWGQGTLVTVSS

*FIG. 8M*

Anti-Tumor Antigen Antibody Domains
Variable domains (CDRs in bold)

Nectin-4

66.3 $V_H$ (SEQ ID NO: 151)
QVQLQQSGPELVKPGASVRISCKASGYTFTTYYIHWVKQRPGQGLEWIGWIYPGNVNTNYNEKF
KGKATLTADKSSSTAYMQLTSLTSEDSAVYFCARGVYYFDYWGQGTLTVSS 66.3 $V_L$ (SEQ ID NO: 161)
SIVMTQTPKFLLVSAGDRVTITCKASQSVNNDVSWFQQKPGQSPTLLIYYASNRYTGVPDRFTGSG
YGTDFTFTISTVQAEDLAVYFCQQDYSSPYTFGGGTKLEIK

EGFR (from WO 2011/059762)

Hu225-G30Y $V_H$ (SEQ ID NO: 171)
EVQLVESGGGLVQPGGSLRLSCAASGFSLTNYGVHWVRQAPGKGLEWLGVIWSGGNTDYNTPF
TSRLTINKDNSKNTVYLQMNSLRAEDTAVYYCARALTYYDYEFAYWGQGTLVTVSS

Hu225-G30Y $V_L$ (SEQ ID NO: 181)
DILLTQSPGTLSLSPGERATLSCRASQSIYTNIHWYQQKPGQAPRLLIKYASESISGIPDRFSGSGSGT
DFTLTISRLEPEDFAVYYCQQNNNWPTTFGQGTKLEIK

PSMA

SAM3.1 $V_H$ (SEQ ID NO: 191)
DVQLQESGPGLVKPSQSLSLTCSVTGYSITSGYYWNWIRQFPGSKLEWMGYISYDGNNNYNPSLK
NRISITRDTSKNQFFLKLNSVTTEDTATYYCARERYYDYDYGYAVDYWGQGTSVTVSS

SAM3.1 $V_L$ (SEQ ID NO: 201)
DIQMTQSPASLSVSVGETVTITCRASENIYSNLAWYQQKQGKSPQLLVYGATNLADGVTSRFSGSG
SGTQYSLKINSLQSEDFGSYYCQNFWGTTWTFGGGTKLEIK

*FIG. 10A*

Anti-CD40 anti-Nectin-4 Bispecific Binding Proteins
(CD40 CDRs in bold; nectin-4 CDRs in bold underline; constant region in *italics dotted underline*)

R87 (SEQ ID NO: 413)

QVQLQQSGPELVKPGASVRISCKASGYTFTTYYIHWVKQRPGQGLEWIGWIYPGN
VNTNYNEKFKGKATLTADKSSTAYMQLTSLTSEDSAVYFCARGVYYFDYWGQG
TILTVSSDLSGGGGSGGGGSGGGGSGGGGSQSPTLLIYYASNRYTGVPDRFTGSGYGTDFTFTISTVQAED
SQSVNNDVSWFQQKPGQSPTLLIYYASNRYTGVPDRFTGSGYGTDFTFTISTVQAED
LAVYFCQQDYSSPYTFGGGTKLEIKRLEEPKSSDKTHTCPPCPAPELLGGPSVFLFPP
*KPKDTLMISRTPEVTCVVVDVSHEDPEYKFNWYVDGVEVHNAKTKPREEQYNSTYRVVSV*
*LTVLHQDWLNGKEYKCKVSNKALPAPIEKTISKAKGQPREPQVYTLPPSREEMTKNQVSL*
*TCLVKGFYPSDIAVEWESNGQPENNYKTTPPVLDSDGSFFLYSKLTVDKSRWQQGNVFSC*
*SVMHEALHNHYTQKSLSLSPGK*VDGASSPVNVSSPSVQDIEVQLVQSGAEVKKPGSSV
KVSCKASGYTFTSYWMHWVRQAPGQGLEWIGNIDPSNGETHYNQKFKDRATLT
VDKSTSTAYMELSSLRSEDTAVYYCARERIYYSGSTYDGYFDYWGQGTTVTVSSD
LSGGGGSGGGGSGGGGSGGGGSTGDIQLTQSPSFLSASVGDRVTITCSASSSLSYMH
WYQQKPGKSPKRWIYDTSKLASGVPSRFSGSGSGTEYTLTISSLQPEDFATYYCQQ
WSSNPWTFGGGTKVEIKR

R88 (SEQ ID NO: 414)

SIVMTQTPKFLLVSAGDRVTITCKASQSVNNDVSWFQQKPGQSPTLLIYYASNRYTG
VPDRFTGSGYGTDFTFTISTVQAEDLAVYFCQQDYSSPYTFGGGTKLEIKRDLSGGG
GSGGGGSGGGGSGGGGSTGQVQLQQSGPELVKPGASVRISCKASGYTFTTYYIHW
VKQRPGQGLEWIGWIYPGNVNTNYNEKFKGKATLTADKSSTAYMQLTSLTSEDS
AVYFCARGVYYFDYWGQGTILTVSSLEEPKSSDKTHTCPPCPAPELLGGPSVFLFPPK
*PKDTLMISRTPEVTCVVVDVSHEDPEYKFNWYVDGVEVHNAKTKPREEQYNSTYRVVSVL*
*TVLHQDWLNGKEYKCKVSNKALPAPIEKTISKAKGQPREPQVYTLPPSREEMTKNQVSLT*
*CLVKGFYPSDIAVEWESNGQPENNYKTTPPVLDSDGSFFLYSKLTVDKSRWQQGNVFSCS*
*VMHEALHNHYTQKSLSLSPGK*VDGASSPVNVSSPSVQDIEVQLVQSGAEVKKPGSSVK
VSCKASGYTFTSYWMHWVRQAPGQGLEWIGNIDPSNGETHYNQKFKDRATLTV
DKSTSTAYMELSSLRSEDTAVYYCARERIYYSGSTYDGYFDYWGQGTTVTVSSDLS
GGGGSGGGGSGGGGSGGGGSTDIQMTQSPSSLSASVGDRVTITCSASSSLSYMHW
YQQKPGKSPKRWIYDTSKLASGVPSRFSGSGSGTEYTLTISSLQPEDFATYYCQQW
SSNPWTFGGGTKVEIKR

*FIG. 10B*

Anti-CD40 anti-Tumor Bispecific Binding Proteins
(CD40 CDRs in bold; tumor antigen CDRs in <u>bold underline</u>; constant region in *italics dotted underline*)

R89 (SEQ ID NO: 415)

DVQLQESGPGLVKPSQSLSLTCSVTGYSITSGYYWNWIRQFPGSKLEWMGYISYDGNNNYNPSLKNRISITRDTSKNQF
FLKLNSVTTEDTATYYCARE<u>RYYDYDGYAVD</u>YWGQGTSVTVSSDLSGGGGSGGGGSGGGGSTGDIQMTQSPA
SLSVSVGETVTITCR<u>ASENIYSNLA</u>WYQQKQGKSPQLLVY<u>GATNLAD</u>GVTSRFSGSGSGTQYSLKINSLQSEDFGSYYC
QNFWGTTWTFGGGTKLEIKRLEEPKSSDKTHTCPPCPAPELLGGPSVFLFPPKPKDTLMISRTPEVTCVVVDVSHEDPEYKF
*NWYVDGVEVHNAKTKPREEQYNSTYRVVSVLTVLHQDWLNGKEYKCKVSNKALPAPIEKTISKAKGQPREPQVYTLPPSREEMT*
*KNQVSLTCLVKGFYPSDIAVEWESNGQPENNYKTTPPVLDSDGSFFLYSKLTVDKSRWQQGNVFSCSVMHEALHNHYTQKSLSL*
*SPG*KVDGASSPVNVSSPSVQDIEVQLVQSGAEVKKPGSSVKVSCKASGYTFTSYWMHWVRQAPGQGLEWIGNIDPSNG
ETHYNQKFKDRATLTVDKSTSTAYMELSSLRSEDTAVYYCARERIYYSGSTYDGYFDVWGQGTTVTVSSDLSGGGGS
GGGGSGGGGSTGDIQLTQSPSFLSASVGDRVTITCSASSSLSYMHWYQQKPGKSPKRWIYDTSKLASGVPSRFS
GSGSGTEYTLTISSLQPEDFATYYCQQWSSNPWTFGGGTKVEIKR

R90 (SEQ ID NO: 416)

DIQMTQSPASLSVSVGETVTITCR<u>ASENIYSNLA</u>WYQQKQGKSPKLEIKRDLSGGGGSGGGGSGGGGSTGDVQLQESGPGLVKPSQSLSLTCSVT
GYSITSGYYWNWIRQFPGSKLEWMGYISYDGNNNYNPSLKNRISITRDTSKNQFFLKLNSVTTEDTATYYCARE<u>RYYD</u>
<u>YDGYAVD</u>YWGQGTSVTVSSLEEPKSSDKTHTCPPCPAPELLGGPSVFLFPPKPKDTLMISRTPEVTCVVVDVSHEDPEYKFN
*WYVDGVEVHNAKTKPREEQYNSTYRVVSVLTVLHQDWLNGKEYKCKVSNKALPAPIEKTISKAKGQPREPQVYTLPPSREEMTK*
*NQVSLTCLVKGFYPSDIAVEWESNGQPENNYKTTPPVLDSDGSFFLYSKLTVDKSRWQQGNVFSCSVMHEALHNHYTQKSLSLS*
*PGK*VDGASSPVNVSSPSVQDIEVQLVQSGAEVKKPGSSVKVSCKASGYTFTSYWMHWVRQAPGQGLEWIGNIDPSNG
ETHYNQKFKDRATLTVDKSTSTAYMELSSLRSEDTAVYYCARERIYYSGSTYDGYFDVWGQGTTVTVSSDLSGGGGS
GGGGSGGGGSTGDIQLTQSPSFLSASVGDRVTITCSASSSLSYMHWYQQKPGKSPKRWIYDTSKLASGVPSRFS
GSGSGTEYTLTISSLQPEDFATYYCQQWSSNPWTFGGGTKVEIKR

*FIG. 10C*

Anti-CD40 anti-Tumor Bispecific Binding Proteins
(CD40 CDRs in bold; tumor antigen CDRs in *italics dotted underline*; constant region in bold underline)

A16 (SEQ ID NO: 417)

EVQLVESGGGLVQPGGSLRLSCAASGFSLTNYGVHWVRQAPGKGLEWLGVIWSGGNTDYNTPFTSRLTINKDNSKNT
VYLQMNSLRAEDTAVYYCARALTYYDYEFAYWGQGTLVTVSSDLSGGGSGGGGSGGGGSGGGGSTGDFLTLSRLEPEDFAVYYCQQNN
LSLSPGERATLSCRASQSIYTNIHWYQQKPGQAPRLLLIKYASESISGIPDRFSGSGSGTDFTLTISRLEPEDFAVYYCQQNN
NWPTTFGQGTKLEIKRLEEPKSSDKTHTCPPCPAPELLGGPSVFLFPPKPKDTLMISRTPEVTCVVVDVSHEDPEYKFNWYVD
GVEVHNAKTKPREEQYNSTYRVVSVLTVLHQDWLNGKEYKCKVSNKALPAPIEKTISKAKGQPREPQVYTLPPSREEMTKNQVS
*LTCLVKGFYPSDIAVEWESNGQPENNYKTTPPVLDSDGSFFLYSKLTVDKSRWQQGNVFSCSVMHEALHNHYTQKSLSLSPGKV*
DGASSPVNVSSPSVQDIEVQLVQSGAEVKKPGSSVKVSCKASGYTFTSYWMHWVRQAPGQGLEWIGNIDPSNGETHY
NQKFKDRATLTVDKSTSTAYMELSSLRSEDTAVYYCARERIYYSGSTYDGYFDVWGQGTTVTVSSDLSGGGGSGGG
SGGGGSGGGGSTGDIQLTQSPSFLSASVGDRVTITCSASSSLSYMHWYQQKPGKSPKRWIYDTSKLASGVPSRFSGSGSG
TEYTLTISSLQPEDFATYYCQQWSSNPWTFGGGTKVEIKR

A17 (SEQ ID NO: 418)

DILLTQSPGTLSLSPGERATLSCRASQSIYTNIHWYQQKPGQAPRLLLIKYASESISGIPDRFSGSGSGTDFTLTISRLEPEDF
AVYYCQQNNNWPTTFGQGTKLEIKRDLSGGGGSGGGGSGGGGSTGEVQLVESGGGLVQPGGSLRLSCAASGF
SLTNYGVHWVRQAPGKGLEWLGVIWSGGNTDYNTPFTSRLTINKDNSKNTVYLQMNSLRAEDTAVYYCARALTYYD
YEFAYWGQGTLVTVSSLEEPKSSDKTHTCPPCPAPELLGGPSVFLFPPKPKDTLMISRTPEVTCVVVDVSHEDPEYKFNWYV
DGVEVHNAKTKPREEQYNSTYRVVSVLTVLHQDWLNGKEYKCKVSNKALPAPIEKTISKAKGQPREPQVYTLPPSREEMTKNQV
*SLTCLVKGFYPSDIAVEWESNGQPENNYKTTPPVLDSDGSFFLYSKLTVDKSRWQQGNVFSCSVMHEALHNHYTQKSLSLSPGK*
VDGASSPVNVSSPSVQDIEVQLVQSGAEVKKPGSSVKVSCKASGYTFTSYWMHWVRQAPGQGLEWIGNIDPSNGETH
YNQKFKDRATLTVDKSTSTAYMELSSLRSEDTAVYYCARERIYYSGSTYDGYFDVWGQGTTVTVSSDLSGGGGSGGG
GSGGGGSGGGGSTGDIQLTQSPSFLSASVGDRVTITCSASSSLSYMHWYQQKPGKSPKRWIYDTSKLASGVPSRFSGSGS
GTEYTLTISSLQPEDFATYYCQQWSSNPWTFGGGTKVEIKR

*FIG. 10D*

Anti-B7-H4 Antibody Domains
Variable domains (CDRs in bold)

Mouse 182.19.1 V$_H$ (SEQ ID NO:211)

QVQLRQPGAELVKPGASVKLSCKTSGYTFTSYWMHWVKQRPGQGLEWIGEIDPSDSYINYNQKFKGEATLTVDKSSS
TAYMQLSSLTSEDSAVYYCARGPRDYWGQGTTLTVSS

Mouse 182.19.1 V$_L$ (SEQ ID NO:221)

DIQMTQTTSSLSASLGDRVTISCSASQGISNYLNWYQQKPDGTVKLLIYYTSRLHSGVPSRFSGSGSGTDFSLTISNLEPE
DIATYYCQQYSKLPYTFGGGTKLEVK

Mouse 182.17.1 V$_H$ (SEQ ID NO:212)

QVQLQQSGAELARPGASVKLSCKASGYTFTFTTYWMQWVKQRPGQGLEWIGAIYPGDGDTRYTQKFKGKATLTADKS
SSTAYMQLSSLASEDSAVYYCARGRDYSGSSWTWFAYWGQGTLVTVSA

Mouse 182.17.1 V$_L$ (SEQ ID NO:222)

DIVMSQSPSSLAVSAGEKVTMSCKSSQSLLNSRTRKSYLAWYQQKPGQSPKVLIYWASSRESGVPDRFTGSGSGTDFTL
TISSVQPEDLAVYYCKQSYNLYTFGGGTKLEIK humanized 182.19.1.1a V$_H$ (SEQ ID NO:213)

EVQLVQSGAEVKKPGSSVKVSCKTSGYTFTSYWMHWVRQAPGQGLEWIGEIDPSDSYINYNQKFKGRATLTVDKSTS
TAYMELSSLRSEDTAVYYCARGPRDYWGQGTTVTVSS humanized 182.19.1.1a V$_L$ (SEQ ID NO:223)

DIQMTQSPSSLSASVGDRVTITCSASQGISNYLNWYQQKPGKAVKLLIYYTSRLHSGVPSRFSGSGSGTDFTLTISSLQPE
DFATYYCQQYSKLPYTFGGGTKVEIK

*FIG. 10E*

Anti-B7-H4 Antibody Domains
Variable domains (CDRs in bold)

humanized 182.17.1.1b $V_H$ (SEQ ID NO:214)
EVQLVQSGAEVKKPGSSVKVSCKASGYTFTTYWMQWVRQAPGQGLEWMGAIYPGDGDTRYTQKFKGRVTLTADKSTSTAYMELSSLRSEDTAVYYCARGRDYSGSSWTWFAYWGQGTLVTVSS Humanized 182.17.1.1b $V_L$ (SEQ ID NO:224)
DIVMTQSPDSLAVSLGERATINCKSSQSLLNSRTRKSYLAWYQQKPGQPPKVLIYWASSRESGVPDRFSGSGSGTDFTLTISSLQAEDVAVYYCKQSYNLYTFGGGTKVEIK humanized 182.19.1.1b $V_H$ (SEQ ID NO:215)
EVQLVQSGAEVKKPGSSVKVSCKASGYTFTSYWMHWVRQAPGQGLEWMGEIDPSDSYINYNQKFKGRVTLTVDKSTSTAYMELSSLRSEDTAVYYCARGPRDYWGQGTLVTVSS Mouse 182.10.21 $V_H$ (SEQ ID NO:216)
EVKLVESGGGLVQPGGSVRLSCATSGFTFSDYYMSWVRQPPGKALELLGFIRNKANGYTREYSASVKGRFTMSRDNSQSVLYLQMNTLRAEDSATYYCARDSHRTYFDYWGQGTTLTVSS Mouse 182.10.21 $V_L$ (SEQ ID NO:225)
QIVLSQSPAILSASPGEKVTMTCRASSSVSSMHWYQQKPGSSSPKPWIYATSNLASGVPTRFSGSGSGTSYSLTISRVEAEDAATYYCQQWSSNPPMYTFGGGTKLEIK humanized 182.10.21.b.1a $V_H$ (SEQ ID NO:217)
EVQLVESGGGLVQPGGSLRLSCATSGFTFSDYYMSWVRQAPGKGLELLGFIRNKANGYTREYSASVKGRFTMSRDNSKNSLYLQMNSLKTEDTAVYYCARDSHRTYFDYWGQGTTVTVSS humanized 182.10.21.1a $V_L$ (SEQ ID NO:226)
EIVLTQSPDFQSVTPKEKVTITCRASSSVSSMHWYQQKPDQSPKPWIYATSNLASGVPSRFSGSGSGTDYTLTINSLEAEDAATYYCQQWSSNPPMYTFGGGTK

*FIG. 10F*

Anti-B7-H4 Antibody Domains
Variable domains (CDRs in bold)

humanized 182.10.21.2a V$_L$ (SEQ ID NO:227)
DIQLTQSPSFLSASVGDRVTITCRASSSVSSMHWYQQKPGKSPKPWIYATSNLASGVPSRFSGSGSGTEYTLTISSLQPEDF ATYYCQQWSSNPPMYTFGGGTKVEIK Mouse 181.23.1 V$_H$ (SEQ ID NO:218)
DVQLQESGPGLVKPAQSLTCSVTGYSITSGYYWNWNRQFPGIKLEWMGYITYEGTNNYNPSLKNRISITRDTSKNQF FLKLNSVTTEDTATYYCAREALWRAMDYWGQGTSVTVSS Mouse 181.23.1 V$_L$ (SEQ ID NO:228)
ENVLTQSPAIMSASPGEKVTMTCSASSSVSYMHWYQQKSGTSPKLWIYDTSKLASGVPGRFSGSGSGNSYSLTISSMEA EDVATYYCFQGSGYPLTFGAGTKLELK humanized 181.23.1.1a V$_H$ (SEQ ID NO:219)
EVQLQESGPGLVKPSGTLSLTCAVTGYSITSGYYWNWNRQFPGKGLEWMGYITYEGTNNYNPSLKNRISISRDKSKNQ FSLKLSSVTAADTAVYYCAREALWRAMDYWGQGTTVTVSS humanized 181.23.1.1a V$_L$ (SEQ ID NO:229)
DNQLTQSPSFLSASVGDRVTITCSASSSVSYMHWYQQKPGKSPKLWIYDTSKLASGVPSRFSGSGSGTEYSLTISSLQPED FATYYCFQGSGYPLTFGQGTKLEIK humanized 181.23.1.1b V$_L$ (SEQ ID NO:230)
DNQLTQSPSFLSASVGDRVTITCSASSSVSYMHWYQQKPGKAPKLWIYDTSKLASGVPSRFSGSGSGTEYTLTISSLQPE DFATYYCFQGSGYPLTFGQGTKLEIK

FIG. 10G

Anti-4-1BB anti-B7-H4 Bispecific Binding Proteins
(4-1BB CDRs in bold; B7-H4 CDRs in bold underline; constant region in *italics dotted underline*)

Hu106B7H4-1 (SEQ ID NO:441)

EVQLVQSGAEVKKPGSSVKVSCKASGYTFTSYYIYWVRQAPGQGLEWIGNIWPGNGGTFYGEKFMGRATFTADT
STSTAYMELSSLRSEDTAVYYCARRPDYSGDDYFDYWGQGTLVTVSSGGGGSGGGGSGGGGSGGGGSGG
GGSNVMLTQPHSVSESPGKTVTISCKLNSGNIGSYYVHWYQQRPGSSPTTMIYRDDKRPDGVPDRFSGSIDSSSNSA
SLTISGLKTEDEADYYCHSYDSTITPVFGGGTKLTVLGQEPRGPTIKPCPPCKCPAPNAAGGPSVFIFPPKIKDVLMISLS
PIVTCVVVDVSEDDPDVQISWFVNNVEVHTAQTQTHREDYNSTLRVVSALPIQHQDWMSGKEFKCKVNNKDLPAPIERTISK
PKGSVRAPQVYVLPPPEEEMTKKQVTLTCMVTDFMPEDIYVEWTNNGKTELNYKNTEPVLDSDGSYFMYSKLRVEKKNWV
ERNSYSCSVVHEGLHNHHTTKSFSRTPGK*GGGGSGGGGSGGGGSGGGGSEVQLVQSGAEVKKPGSSVKVQSGAEVKKPGSSVK*
LNWYQQKPGKAVKLLIYYTSRLHSGVPSRFSGSGSGTDFTLTISSLQPEDFATYYCQQYSKLPYTFGGGTKVEIKRG
GGGSGGGGSGGGGSGGGGSLEWIGEIDPSDSYINYNQKFKGRATLTVDKSTSTAYMELSSLRSEDTAVYYCARGPRDYWGQGTTVTVSSSGAEVKKPGSSVKVSCKTSGYTFTSYYMHWVRQAPGQG

Hu106B7H4-2 (SEQ ID NO:442)

EVQLVQSGAEVKKPGSSVKVSCKASGYTFTSYYIYWVRQAPGQGLEWIGNIWPGNGGTFYGEKFMGRATFTADT
STSTAYMELSSLRSEDTAVYYCARRPDYSGDDYFDYWGQGTLVTVSSGGGGSGGGGSGGGGSGGGGSGG
GGSNVMLTQPHSVSESPGKTVTISCKLNSGNIGSYYVHWYQQRPGSSPTTMIYRDDKRPDGVPDRFSGSIDSSSNSA
SLTISGLKTEDEADYYCHSYDSTITPVFGGGTKLTVLGQEPRGPTIKPCPPCKCPAPNAAGGPSVFIFPPKIKDVLMISLS
PIVTCVVVDVSEDDPDVQISWFVNNVEVHTAQTQTHREDYNSTLRVVSALPIQHQDWMSGKEFKCKVNNKDLPAPIERTISK
PKGSVRAPQVYVLPPPEEEMTKKQVTLTCMVTDFMPEDIYVEWTNNGKTELNYKNTEPVLDSDGSYFMYSKLRVEKKNWV
ERNSYSCSVVHEGLHNHHTTKSFSRTPGK*GGGGSGGGGSGGGGSGGGGSEVQLVQSGAEVKKPGSSVKVSCKTS**GYTFTS
YYMHWVRQAPGQGLEWIGEIDPSDSYINYNQKFKGRATLTVDKSTSTAYMELSSLRSEDTAVYYCARGPRDYW**G
QGTTVTVSSGGGGSGGGGSGGGGSGGGGSEVQLVQSGAEVKKPGSSVKVQSGAEVKKPGSSVK*KLLIYYTSRLHSGVPSRFSGSGSGTDFTLTISSLQPEDFATYYCQQYSKLPYTFGGGTKVEIKR

*FIG. 10H*

Anti-4-1BB anti-B7-H4 Bispecific Binding Proteins
(4-1BB CDRs in bold; B7-H4 CDRs in bold underline; constant region in *italics dotted underline*)

Hu106B7H4-3 (SEQ ID NO:443)

EVQLVQSGAEVKKPGSSVKVSCKASGYTFTSYYIYWVRQAPGQGLEWIGNIWPGNGGTFYGEKFMGRATFTADT
STSTAYMELSSLRSEDTAVYYCARRPDYSGDDYFDYWGQGTLVTVSSGGGGSGGGGSGGGGSGGGGSGG
GGSNVMLTQPHSVSESPGKTVTISCKLNSGNIGSYYVHWYQQRPGSSPTTMIYRDDKRPDGVPDRFSGSIDSSNSA
SLTISGLKTEDEADYYCHSYDSTITPVFGGGTKLTVLGQEPRGPTIKPCPPCKCPAPNAAGGPSVFIFPPKIKDVLMISLS
*PIVTCVVVDVSEDDPDVQISWFVNNVEVHTAQTQTHREDYNSTLRVVSALPIQHQDWMSGKEFKCKVNNKDLPAPIERTISK*
*PKGSVRAPQVYVLPPPEEEMTKKQVTLTCMVTDFMPEDIYVEWTNNGKTELNYKNTEPVLDSDGSYFMYSKLRVEKKNWV*
*ERNSYSCSVVHEGLHNHHTTKSFSRTPGK*GGGGSGGGGSGGGGSGGGGSEVQLVQSGGGLVQPGGSLRLSCAASGFTFSSYAMSWVRQAPGKGLEWVSRTRKSYLAWYQQKPGQPPKVLIYWASSRESGVPDRFSGSGGGSGGGGSEVQLVQSGGGLVQPGGSLRLSCAASGFTFSSYAMSWVRQAPGKGLEWVS
RTRKSYLAWYQQKPGQPPKVLIYWASSRESGVPDRFSGSGSGTDFTLTISSLQAEDVAVYYCKQSYNLYTFGGGTK
VEIKRGGGGSGGGGSGGGGSGGGGSEVQLVQSGAEVKKPGSSVKVSCKASGYTFTTYWMQWVR
QAPGQGLEWMGAIYPGDGDTRYTQKFKGRVTLTADKSTSTAYMELSSLRSEDTAVYYCARGRDY
SGSSWTWFAYWGQGTLVTVSS

Hu106B7H4-4 (SEQ ID NO:444)

EVQLVQSGAEVKKPGSSVKVSCKASGYTFTSYYIYWVRQAPGQGLEWIGNIWPGNGGTFYGEKFMGRATFTADT
STSTAYMELSSLRSEDTAVYYCARRPDYSGDDYFDYWGQGTLVTVSSGGGGSGGGGSGGGGSGGGGSGG
GGSNVMLTQPHSVSESPGKTVTISCKLNSGNIGSYYVHWYQQRPGSSPTTMIYRDDKRPDGVPDRFSGSIDSSNSA
SLTISGLKTEDEADYYCHSYDSTITPVFGGGTKLTVLGQEPRGPTIKPCPPCKCPAPNAAGGPSVFIFPPKIKDVLMISLS
*PIVTCVVVDVSEDDPDVQISWFVNNVEVHTAQTQTHREDYNSTLRVVSALPIQHQDWMSGKEFKCKVNNKDLPAPIERTISK*
*PKGSVRAPQVYVLPPPEEEMTKKQVTLTCMVTDFMPEDIYVEWTNNGKTELNYKNTEPVLDSDGSYFMYSKLRVEKKNWV*
*ERNSYSCSVVHEGLHNHHTTKSFSRTPGK*GGGGSGGGGSGGGGSGGGGSEVQLVQSGAEVKKPGSSVKVSCKASGYTFT
TYWMQWVRQAPGQGLEWMGAIYPGDGDTRYTQKFKGRVTLTADKSTSTAYMELSSLRSEDTAVYYCARGRDY
SGSSWTWFAYWGQGTLVTVSSGGGGSGGGGSGGGGSGGGGSDIVMTQSPDSLAVSLGERATINCKQSYNL
SSQSLLNSRTRKSYLAWYQQKPGQPPKVLIYWASSRESGVPDRFSGSGSGTDFLTISSLQAEDVAVYYCKQSYNL
YTFGGGTKVEIKR

*FIG. 10I*

Anti-PSMA Antibody Domains
Variable domains (CDRs in bold)

SAM103 V$_H$ (SEQ ID NO:192)
EVKLVESEGGLVQPGSSMKLSCTASGFTFSDYYMAWVRQVPEKGLEWVANINYDGTTTYYLDSLKSRFIISRDNSKNILYLQMSSLKSEDTATYYCARVLDGYYGYFDYWGQGTTLSVSS

SAM103 V$_L$ (SEQ ID NO:202)
QIVLTQSPAIMSASPGEKVTISCSASSSVSYMYWYQQKPGSSPKPWIYRTYNLASGVPARFSGSGSGTSYSLTISSMEAEDAATYYCQQSHTYPPTFGGGTKLEIK

SAM4.1 V$_H$ (SEQ ID NO:193)
DVKLVESEGEGLVKPGGSLKLSCAASGFTFSSYAMSWVRQTPEKRLEWVAYISSGGDYIYYADTMKGRFTISRDNARNTLYLQMSSLKSEDTAMYYCTRVFDGYYARFLYWGQGTLVTVSA

SAM4.1 V$_L$ (SEQ ID NO:203)
DIVMTQSQKFMSTSVGDRVSVTCKASQNVDTNVAWYQQKPGQSPKALIYSTSYRYSGVPDRFTGSSGSGTDFTLTININVQSEDLAEYFCQQYNNYPLTFGTGTKLELK

SAM5.1 V$_H$ (SEQ ID NO:194)
QVTLKESGPGILQSSQTLSLTCSFSGFSLSTSGMGVSWIRQPSGKGLEWLAHIYWDDDQRYNPSLKSRLTISKDASGNQVFLKITSVDTADTATYYCTRRGGYGSSSKGYYYVMDYWGQGTSVTVSS

SAM5.1 V$_L$ (SEQ ID NO:204)
DIQMTQSPSSLSASLGERVSLTCRASQDIGTRLNWLQQEPDGTIKRLIYATSSLDSGVPKRFSGSRSGSVYSLTISSLESEDFVDYYCVQYASSPYTFGGGTKLEIK

*FIG. 10J*

Anti-PSMA Antibody Domains
Variable domains (CDRs in bold)

SAM13.1 V$_H$ (SEQ ID NO:195)

QVQLQQPGAELVKPGASVKVSCKASGYTFTNYWMHWVKQRPGQGLEWIGRIHPSDSDTNYNQRFKGKATLTVDKSSTTAYMQLSSLTSEDSAVYYCAIEDYSNYVDFDWGTGTTVTVSS

SAM13.1 V$_L$ (SEQ ID NO:205)

DILLTQSPASLAVSLGQRATISCRASESVDTYGITFIHWYQQKPGQPPKLLIYRASNLESGIPARFSGSGSKTDFTLTINPVETDDVATYYCQQNNKDPRTFGGGTKLEIR

SAM16.2 V$_H$ (SEQ ID NO:196)

QIQLVQSGPELKKPGETVKISCKASGYTFTTYGVSWVKQAPGKGLKVMGWINTYSGVPTYADDFKGRFAFSLETSASTAYLQITNLKNEDTATYFCARQEAFYNRTMDYWGQGTSVTVSS

SAM16.2 V$_L$ (SEQ ID NO:206)

ENVLTQSPAIMSASPGEKVTMTCRASSSVSSSYLHWYQQKSGASPKLWIYSRSTLASGVPARFSGSGSGTSYSLTISSVEAEDAATYYCQQYRGYPLTFGSGTKLEIK

SAM17.1 V$_H$ (SEQ ID NO:197)

EVQLQQSGPVLVKPGASVKMSCKASGYTFTDYYMNWVKQSHGKSLEWIGLINPNSGGINYNQKFKVKATLTVDKSSSTAYMELNSLTSEDSAVYYCARRDYGTSGDYWGQGTSVTVSS

SAM17.1 V$_L$ (SEQ ID NO:207)

DIQMNQSPSSLSASLGDTITITCHASQNINVWLSWYQQKPGNIPKLLIYKASNLHTGVPSRFSGSGSGTGFTLTISSLQPEDIATYYCQQGQSYPLTFGAGTKLELK

FIG. 10K

Anti-4-1BB anti-PSMA Bispecific Binding Proteins
(4-1BB CDRs in bold; PMSA CDRs in _bold underline_)

hu106mPSMA-1 (SEQ ID NO: 445)

EVQLVQSGAEVKKPGSSVKVSCKASGYTFTSYYIYWVRQAPGQGLEWIGNIWPGNGGTFYGEKFMGRAT
FTADTSTSTAYMELSSLRSEDTAVYYCARRPDYSGDDYFDYWGQGTLVTVSSGGGGSGGGGSGGGGSGGG
GSGGGGSGGGGSNVMLTQPHSVSESPGKTVTISCKLNSGNIGSYYVHWYQQRPGSSPTTMIYRDDKRPDGV
PDRFSGSIDSSSNSASLTISGLKTEDEADYYCHSYDSTITPVFGGGTKLTVLGQEPRGPTIKPCPPCKCPAPNAA
_GGPSVFIFPPKIKDVLMISLSPIVTCVVVDVSEDDPDVQISWFVNNVEVHTAQTQTHREDYNSTLRVVSALPIQHQDW_
_MSGKEFKCKVNNKDLPAPIERTISKPKGSVRAPQVYVLPPPEEEMTKKQVTLTCMVTDFMPEDIYVEWTNNGKTEL_
_NYKNTEPVLDSDGSYFMYSKLRVEKKNWVERNSYSCSVVHEGLHNHHTTKSFSRTPGK_GGGGSGGGGSGGGGSGGG
GSEVKLVESEGGLVQPGGSLRLSCAASGFTFSDYYMAWVRQVPEKGLEWVANINYDGTTTYYLDSLKSRF
IISRDNSKNILYLQMSSLKSEDTATYYCARVLDGYYGYFDYWGQGTTLSVSSGGGGSGGGGSGGGGSGGG
GSGGGGSGGGGSQIVLTQSPAIMSASPGEKVTISCSASSSVSYMYWYQQKPGSSPKPWIYRTYNLASGVPARFS
GSGSGTSYSLTISSMEAEDAATYYCCQQSHTYPPTFGGGTKLEIKR hu106mPSMA-2 (SEQ ID NO: 446)

EVQLVQSGAEVKKPGSSVKVSCKASGYTFTSYYIYWVRQAPGQGLEWIGNIWPGNGGTFYGEKFMGRAT
FTADTSTSTAYMELSSLRSEDTAVYYCARRPDYSGDDYFDYWGQGTLVTVSSGGGGSGGGGSGGGGSGGG
GSGGGGSGGGGSNVMLTQPHSVSESPGKTVTISCKLNSGNIGSYYVHWYQQRPGSSPTTMIYRDDKRPDGV
PDRFSGSIDSSSNSASLTISGLKTEDEADYYCHSYDSTITPVFGGGTKLTVLGQEPRGPTIKPCPPCKCPAPNAA
_GGPSVFIFPPKIKDVLMISLSPIVTCVVVDVSEDDPDVQISWFVNNVEVHTAQTQTHREDYNSTLRVVSALPIQHQDW_
_MSGKEFKCKVNNKDLPAPIERTISKPKGSVRAPQVYVLPPPEEEMTKKQVTLTCMVTDFMPEDIYVEWTNNGKTEL_
_NYKNTEPVLDSDGSYFMYSKLRVEKKNWVERNSYSCSVVHEGLHNHHTTKSFSRTPGK_GGGGSGGGGSGGGGSGGG
GSQIVLTQSPAIMSASPGEKVTISCSASSSVSYMYWYQQKPGSSPKPWIYRTYNLASGVPARFSGSGSGTSYS
LTISSMEAEDAATYYCCQQSHTYPPTFGGGTKLEIKRGGGGSGGGGSGGGGSGGGGSEVKL
VESEGGLVQPGGSLRLSCAASGFTFSDYYMAWVRQVPEKGLEWVANINYDGTTTYYLDSLKSRFIISRDNS
KNILYLQMSSLKSEDTATYYCARVLDGYYGYFDYWGQGTTLSVSS

*FIG. 10L*

BISPECIFIC BINDING PROTEINS THAT BIND CD40 AND MESOTHELIN

1. CROSS REFERENCE TO RELATED APPLICATIONS

This application is a continuation of U.S. application Ser. No. 15/606,200, filed May 26, 2017, which claims the benefit under 35 U.S.C. § 119(e) of U.S. Provisional Application Nos. 62/342,393, filed May 27, 2016, and 62/414,897, filed Oct. 31, 2016, the contents of both of which are incorporated herein in their entireties by reference thereto.

2. SEQUENCE LISTING

The instant application contains a Sequence Listing which has been submitted electronically in ASCII format and is hereby incorporated by reference in its entirety. Said ASCII copy, created on May 17, 2017, is named 381493-284US_SL.txt and is 668,441 bytes in size.

3. FIELD

The present application pertains to, among other things, novel bispecific binding proteins, compositions including the new proteins, nucleic acids encoding the proteins, and methods of making and using the same.

4. BACKGROUND

Cancer therapies comprise a wide range of therapeutic approaches, including surgery, radiation, and chemotherapy. While the various approaches allow a broad selection of treatments to be available to the medical practitioner to treat the cancer, existing therapeutics suffer from a number of disadvantages, such as a lack of selectivity of targeting cancer cells over normal, healthy cells, and the development of resistance by the cancer to the treatment.

Recent approaches based on targeted therapeutics, which interfere with cellular processes of cancer cells preferentially over normal cells, have led to chemotherapeutic regimens with fewer side effects as compared to non-targeted therapies such as radiation treatment.

Cancer immunotherapy, in particular the development of agents that activate T cells of the host's immune system to prevent the proliferation of or kill cancer cells, has emerged as a promising therapeutic approach to complement existing standards of care. See, e.g., Miller, et al. Cancer Cell, 27, 439-449 (2015). Such immunotherapy approaches include the development of antibodies used to modulate the immune system to kill cancer cells. For example, anti-PD-1 blocking antibodies pembrolizumab (KEYTRUDA®) and nivolumab (OPDIVO®) have been approved in the US and the European Union to treat diseases such as unresectable or metastatic melanoma and metastatic non-small cell lung cancer. Efforts to inhibit immunosuppressive proteins such as CTLA-4 have led to the development and clinical evaluation of anti-CTLA-4 antibodies, such as tremelimumab and ipilimumab (YERVOY®).

There remains a need for alternative approaches and additional cancer treatments to complement existing therapeutic standards of care.

5. SUMMARY

The present disclosure provides bispecific binding proteins capable of specifically binding two antigens. The binding proteins generally comprise variable light and variable heavy chain regions or domains that correspond to variable light and variable heavy chain regions or domains of immunoglobulins. At least one antigen binding moiety of the binding proteins is in a single chain format known in the art as an scFv. In some embodiments, the other antigen binding moiety comprises an IgG. In other embodiments, the other antigen binding moiety comprises an scFv.

Accordingly, a bispecific binding protein can comprise two polypeptides linked together via disulfide bonds, with each polypeptide comprising a first scFv region and a second scFv region at its respective N- and C-termini. The two scFv regions specifically bind different antigens. Between the first and second scFv regions of each polypeptide are sequences comprising the hinge, CH2, and CH3 domains of immunoglobulins.

Alternatively, a bispecific binding protein can comprise an IgG that has a scFv region linked at the C-terminal end of each CH3 domain. In this case, the variable heavy and light chains in the Fab regions of the IgG specifically bind one antigen, and the C-terminal scFv regions comprise different variable heavy and light chains that specifically bind a second antigen.

As noted above, a bispecific binding protein can bind to two different antigens via two domains, one at the N-terminal end that binds antigen X and the other at the C-terminal end that binds antigen Y. In some embodiments, the bispecific binding protein binds the first domain of an immunomodulatory protein, for example, to activate an immune receptor, and the second domain of a tumor antigen. In one particular embodiment, the bispecific binding protein agonizes CD40 by binding via the first domain and binds the tumor antigen mesothelin via the second domain. In another embodiment, the bispecific binding protein agonizes 4-1BB by binding via the first domain and binds to mesothelin via the second domain. In such cases, the bispecific binding protein provides for target-specific activation of the immune response in a tumor microenvironment. Such conditional activation of an immunomodulatory protein in the tumor microenvironment may avoid systemic toxicity, potentially allowing for higher dosing and a wider application of immunological anticancer agents.

In one embodiment, a bispecific binding protein comprises two polypeptides of formula (I):

$$X\text{—}H\text{—}Fc\text{—}L\text{—}scFv^Y \quad\quad (I),$$

wherein
  X is $scFv^X$ or a Fab region, wherein X specifically binds a first antigen and $scFv^Y$ specifically binds a second antigen,
  H is a hinge region,
  Fc comprises CH2 and CH3 regions of an immunoglobulin,
  $scFv^X$ and $scFv^Y$ are each independently a single chain variable fragment, and
  L is a polypeptide linker.

In some embodiments, one of the two antigens is an immunomodulatory protein and the other is a tumor antigen. In some embodiments, when X is a Fab region, then the first antigen is a tumor antigen, and the second antigen is an immunomodulatory protein. In some embodiments, when X is a Fab region, then the first antigen is an immunomodulatory protein, and the second antigen is a tumor antigen.

The $V_H$ and $V_L$ chains incorporated into the bispecific binding proteins may be derived from multiple sources, including pre-existing antibodies, newly generated antibodies, and $V_H$ and $V_L$ chain libraries. Specific exemplary embodiments of $V_H$ and $V_L$ chains that may be incorporated into bispecific binding proteins, as well as specific exemplary embodiments of bispecific binding proteins that compete for binding an immunomodulatory protein, such as CD40 or 4-1BB, and a tumor antigen, such as mesothelin, nectin-4, prostate-specific membrane antigen (PSMA), B7-H4, or epidermal growth factor receptor (EGFR), with reference antibodies, are provided in the Detailed Description section.

Nucleic acids comprising nucleotide sequences encoding the polypeptides of the disclosure are provided herein, as are vectors comprising nucleic acids. Additionally, prokaryotic and eukaryotic host cells transformed with a vector comprising a nucleotide sequence encoding a disclosed polypeptide are provided herein, as well as eukaryotic (such as mammalian) host cells engineered to express the nucleotide sequences. Methods of producing polypeptides, by culturing host cells and recovering the polypeptides are also provided, and discussed further in the Detailed Description below.

In another aspect, the present disclosure provides compositions including the bispecific binding proteins described herein. The compositions generally comprise one or more bispecific binding proteins as described herein, and/or salts thereof, and one or more excipients, carriers or diluents.

The bispecific proteins bind specifically to two antigens, such as an immunomodulatory protein and a tumor antigen, and activate immune cells within a tumor microenvironment to achieve antitumor activity. Accordingly, the present disclosure provides methods of treating subjects, such as human subjects, diagnosed with a solid tumor. The method generally involves administering to the subject an amount of a bispecific binding protein described herein effective to provide therapeutic benefit. The subject may be diagnosed with any one of a number of solid tumors that may be newly diagnosed, relapsed, or relapsed and refractory. A bispecific binding protein is typically administered as an intravenous infusion at doses ranging from about 0.005 mg/kg to about 5 mg/kg. A bispecific binding protein is typically administered as an intravenous infusion twice a week, once a week, once every two weeks, once every three weeks, once every four weeks, once every five weeks, once every six weeks, once every seven weeks, or once every eight weeks.

The bispecific binding proteins may be administered as single therapeutic agents (monotherapy) or adjunctive to or with other therapeutic agents typically, but not necessarily, those used for the treatment of a solid tumor. Therapeutic agents typically will be used at their approved dose, route of administration, and frequency of administration, but may be used at lower dosages.

The bispecific binding proteins may be administered via a variety of routes or modes of administration, including but not limited to, intravenous infusion and/or injection, intratumoral injection, and subcutaneous injection. The amount administered will depend upon the route of administration, the dosing schedule, the stage of cancer being treated, and other parameters such as the age and weight of the patient, as is well known in the art. Specific exemplary dosing schedules expected to provide therapeutic benefit are provided in the Detailed Description.

Based on data presented herein, it is expected that the bispecific binding proteins described herein will provide therapeutic benefit to subjects diagnosed with a solid tumor.

6. BRIEF DESCRIPTION OF THE FIGURES

FIGS. 1A-1B show representations of bispecific binding protein formats of the disclosure. FIG. 1A depicts an exemplary embodiment of a bispecific binding protein of the disclosure having scFv regions; FIG. 1B depicts an exemplary embodiment of a bispecific binding protein of the disclosure having an IgG region and scFv regions.

FIGS. 2A-2B depict representations of bispecific binding proteins that do not afford conditional activation when targeting an immunomodulatory protein in the presence of a tumor antigen. FIG. 2A depicts a dual variable domain immunoglobulin (DVD-Ig); FIG. 2B depicts a crossover dual variable domain protein (CO-DVD).

FIGS. 3A-3G depict exemplary amino acid sequences of anti-CD40 antibody variable domains. CDR amino acid sequences are shown in bold. FIGS. 3A-3C depict amino acid sequences of mouse anti-human CD40 antibody variable domains: FIG. 3A shows muAb1 through muAb3 (SEQ ID NOS:1, 31, 2, 32, 3, and 33); FIG. 3B shows muAb4 through muAb7 (SEQ ID NOS:4, 34, 5, 35, 6, and 36-37); FIG. 3C shows muAb8 through muAb10 (SEQ ID NOS:7, 38, 8, 39, 9 and 40). FIGS. 3D-3G depicts amino acid sequences of humanized anti-human CD40 antibody variable domains: FIG. 3D shows antibodies derived from muAb6 and muAb8 (SEQ ID NOS:10, 41, 11-13, 42 and 14); FIG. 3E shows antibodies derived from muAb8 and muAb9 (SEQ ID NOS:15-16, 43, and 17-20); FIG. 3F shows antibodies derived from muAb9 (SEQ ID NOS:21-23, and 44-47); and FIG. 3G shows further antibodies derived from muAb9 (SEQ ID NOS:48-51).

FIGS. 4A-4E depict exemplary amino acid sequences of anti-mesothelin antibody variable domains. CDR amino acid sequences are shown in bold. FIG. 4A shows sequences from HuAb17 and HuAM1 through HuAM4 (SEQ ID NOS:107, 136, 108, 137, and 109-111); FIG. 4B shows sequences from HuAM5 through HuAM9 (SEQ ID NOS: 112-115, 138, and 116); FIG. 4C shows sequences from HuAM11 through HuAM18 (SEQ ID NOS:117, 139, and 118-122); FIG. 4D shows sequences from HuAM19, HuAM21 and HuAM15 variants (SEQ ID NOS:123, 140, and 124-128); FIG. 4E shows sequences from MSLN76923 and a HuAM15 variant (SEQ ID NOS:129 and 141-143).

FIGS. 5A-5C show binding of anti-mesothelin antibodies HuAM5, HuAM11, and HuAM16 in the presence of increasing amounts of CA125 in different cancer cell lines. FIG. 5A depicts OVCAR-3 ovarian cancer cell results; FIG. 5B depicts SW1990 pancreatic cancer cell results; FIG. 5C depicts SN12C renal cancer cell results.

FIGS. 6A-6B depict binding curves of different concentrations of anti-mesothelin antibodies HuAM5, HuAM11, and HuAM16 with or without soluble CA125 in different cell lines. FIG. 6A depicts results in 293 cells expressing mesothelin; FIG. 6B depicts results in OVCAR-3 ovarian cancer cells.

FIGS. 7A-7G depict amino acid sequences of exemplary anti-4-1BB antibody variable domains. FIG. 7A depicts sequences from rat TABBY101 through TABBY103 (SEQ ID NOS:61, 81, 62, 82, 63 and 83); FIG. 7B depicts sequences from rat TABBY104 through TABBY106 (SEQ ID NOS:64, 84, 65, 85, 66 and 86); FIG. 7C depicts sequences from rat TABBY107 and TABBY108 (SEQ ID NOS:67, 87, 68 and 88); FIG. 7D depicts sequences of humanized antibodies (SEQ ID NOS:69, 89, 70, 90, 71 and 91); FIG. 7E depicts additional humanized antibodies (SEQ ID NOS:72 and 92-95); FIG. 7F depicts sequences from mouse TABBY1.1 through TABBY5 (SEQ ID NOS:73, 96, 74, 97, 75 and 98); FIG. 7G depicts sequences from mouse TABBY6 through TABBY10 (SEQ ID NOS:76, 99, 77, 100, 78 and 101). CDR amino acid sequences are shown in bold.

FIGS. 8A-8H depict amino acid sequences of exemplary bispecific binding proteins against CD40 and mesothelin. FIG. 8A shows LB-1and h24 (SEQ ID NOS:400-401); FIG. 8B shows h26 and B37 (SEQ ID NOS:402-403); FIG. 8C shows B38 and B39 (SEQ ID NOS:404-405); FIG. 8D shows B40 and B41 (SEQ ID NOS:406-407; FIG. 8E shows B42 and B43 (SEQ ID NOS:408-409); FIG. 8F shows B44 and B45 (SEQ ID NOS:410-411); FIG. 8G shows B46, and V6-2 (SEQ ID NOS:412 and 419); FIG. 8H shows V6-5 and V6-6 (SEQ ID NOS:420-421). CD40 CDRs are shown in bold; mesothelin CDRs are shown in bold underline; constant region is shown in italics dotted underline.

FIGS. 8I-8M depict amino acid sequences of exemplary bispecific binding proteins against 4-1BB and mesothelin. FIG. 8I shows hu106MSLN-1 and hu106MSLN-2 (SEQ ID NOS:431-432); FIG. 8J shows hu106MSLN-3 and hu106MSLN-4 (SEQ ID NOS:433-434); FIG. 8K shows hu106MSLN-5 and hu106MSLN-6 (SEQ ID NOS:435-436); FIG. 8L shows hu107MSLN-1 and hu107MSLN-2 (SEQ ID NOS:437-438); FIG. 8M shows hu107MSLN-3 and hu107MSLN-4 (SEQ ID NOS:439-440). 4-1BB CDRs are shown in bold; mesothelin CDRs are shown in bold underline; constant region is shown in italics dotted underline.

FIGS. 9A-9B depict activation of immune cells (dendritic cells and B cells, respectively) by bispecific binding proteins of the disclosure in the presence of mesothelin. Black bar depicts results for immune cells co-cultured with HEK293 cells without mesothelin ("293S"); hollow bar depicts results for immune cells co-cultured with HEK293 cells expressing cell-surface human mesothelin ("293S huMSLN"). FIG. 9A shows IL-12p70 levels in dendritic cells (DC) on the y-axis; FIG. 9B shows B cell proliferation in counts per minute (CPM) on the y-axis.

FIGS. 10A-10L depict amino acid sequences of antibody variable domains or corresponding bispecific proteins for immunomodulatory proteins CD40 or 4-1BB and tumor antigens nectin-4, EGFR, B7-H4 or PSMA. FIG. 10A depicts amino acid sequences of exemplary antibody variable domains against nectin-4, EGFR, or PSMA (SEQ ID NOS:151, 161, 171, 181, 191, and 201. CDR amino acid sequences are shown in bold.

FIG. 10B depicts amino acid sequences of exemplary bispecific binding proteins binding CD40 and nectin-4 (SEQ ID NOS:413-414). CD40 CDRs are shown in bold; nectin-4 CDRs are shown in bold underline; constant region is shown in italics dotted underline.

FIG. 10C depicts amino acid sequences of exemplary bispecific binding proteins R89 and R90 binding CD40 and PSMA (SEQ ID NOS:415-416); FIG. 10D depicts amino acid sequences of exemplary bispecific binding proteins A16 and A17 binding CD40 and EGFR (SEQ ID NOS:417-418). CD40 CDRs are shown in bold; tumor antigen CDRs are shown in bold underline; constant region is shown in italics dotted underline.

FIGS. 10E-10G depict amino acid sequences of exemplary murine and humanized antibody variable domains against B7-H4. FIG. 10E shows mouse 182.19.1, a humanized 182.19.1, and mouse 182.17.1 (SEQ ID NOS:211, 221, 212, 222, 213, and 223); FIG. 10F shows mouse 182.10.21 and humanized versions of 182.17.1, 182.19.1, and 182.10.21 (SEQ ID NOS:214, 224, 215-216, 225, 217, and 226); FIG. 10G shows mouse 181.23.1 and humanized versions of 182.10.21 and 181.23.1 (SEQ ID NOS:227, 218, 228, 219, and 229-230). CDR amino acid sequences are shown in bold.

FIGS. 10H and 10I depict amino acid sequences of exemplary bispecific proteins binding 4-1BB and B7-H4. FIG. 10H shows Hu106B7H4-1 and Hu106B7H4-2 (SEQ ID NOS:441-442); FIG. 10I shows Hu106B7H4-3 and Hu106B7H4-4 (SEQ ID NOS:443-444). 4-1BB CDRs are shown in bold; B7-H4 CDRs are shown in bold underline.

FIG. 10J depicts amino acid sequences of exemplary antibody variable domains against PSMA (SEQ ID NOS: 192, 202, 193, 203, 194, and 204); FIG. 10K depicts additional sequences of antibody variable domains against PSMA (SEQ ID NOS:195, 205, 196, 206, 197, and 207). CDR amino acid sequences are shown in bold.

FIG. 10L depicts amino acid sequences of exemplary bispecific proteins binding 4-1BB and PSMA (SEQ ID NOS:445-446). 4-1BB CDRs are shown in bold; PSMA CDRs are shown in bold underline.

FIGS. 11A-11B depict effects of bispecific binding proteins that bind CD40 and either nectin-4 or PSMA in various B cell co-cultures. FIG. 11A depicts the effects of bispecific protein R87 binding CD40 and nectin-4 in B cells cultured alone (upper graph), B cells co-cultured with HEK293 cells (middle graph), and B cells co-cultures with HEK293 cells expressing nectin-4 (lower graph), as compared with isotype control, anti-CD40 antibody huAb6-1, or anti-nectin-4 antibody 66.3. FIG. 11B depicts the effects of bispecific protein R89 binding CD40 and PSMA in B cells cultured with 4T1 cells (upper graph), and B cells co-cultures with 4T1 cells expressing PSMA (lower graph), as compared with isotype control, anti-CD40 antibody huAb6-1, or anti-PSMA antibody SAM3.1.

FIGS. 12A-12B depict effects of bispecific binding proteins that bind 4-1BB and mesothelin in a FACS assay. FIG. 12A shows effects of hu106MSLN-1 through hu106MSLN-4; and FIG. 12B shows effects of hu107MSLN-1 through hu107MSLN-4. The graphs show binding in the presence of HEK293 cells expressing 4-1BB (upper graphs) or HEK293 cells expressing mesothelin (lower graphs).

FIG. 13 depicts the agonistic activity of 4-1BB bispecific proteins binding mesothelin measured by luciferase gene expression driven by NF-κB. Upper graph depicts effects on 4-1BB transfected in HEK293 cells in the presence of an Fc cross-linker; lower graph depicts effects without Fc cross-linker.

FIGS. 14A-14B depict the activity of 4-1BB bispecific proteins binding mesothelin in the presence of HEK293 cells with or without cell-surface mesothelin. Upper graphs depict effects in HEK293 cells expressing mesothelin; lower graphs depict effects in HEK293 cells with mock transfectant. FIG. 14A shows effects of hu106MSLN-1 through hu106MSLN-4; and FIG. 14B shows effects of hu107MSLN-1 through hu107MSLN-4.

FIGS. 15A-15C depict conditional CD8+ T cell activation by bispecific binding proteins of the disclosure binding 4-1BB and mesothelin. FIG. 15A shows CD8+ T cell proliferation effects in counts per minute (cpm) in the presence of CT26 cells expressing mesothelin (upper graph) or in the presence of CT26 cells without mesothelin (lower graph); FIG. 15B shows interferon-gamma secretion from CD8+ T cells in the presence of CT26 cells expressing mesothelin (upper graph) or in the presence of CT26 cells without mesothelin (lower graph). FIG. 15C shows effects of bispecific protein administration on interferon-gamma secretion from CD8+ T cells in the presence of PC3 cells expressing mesothelin (upper graph) or PC3 cells (lower graph).

FIGS. 15D-15E shows the effects of bispecific binding proteins of formula (I) binding 4-1BB and PSMA. FIG. 15D shows the effects of exemplary bispecific proteins in a FACS assay showing binding in the presence of CT26 cells expressing mouse PSMA (upper graph) or HEK293 cells expressing mouse 4-1BB (lower graph). FIG. 15E shows the agonistic activity measured by NFκB activation of exemplary bispecific proteins in the presence of CT26 cells with or without cell-surface PSMA: upper graph depicts effects in CT26 cells expressing mouse PSMA; lower graph depicts effects in CT26 cells with mock transfectant.

FIG. 16 shows effects of bispecific binding proteins of formula (I) binding CD40 and mesothelin as compared to isotype control antibody in co-cultures of PC3 tumor cell expressing mesothelin with DC and T cells.

FIGS. 17A-17B show effects of bispecific binding proteins of formula (I) binding CD40 and mesothelin ("MSLN"), PSMA, or nectin-4 in mouse PC3 cancer cell models. FIG. 17A shows effects of bispecific binding protein h24 in PC3 tumors expressing mesothelin (upper graph) and effects of bispecific binding protein R89 in PC3 tumors expressing PSMA (lower graph). FIG. 17B shows effects of bispecific binding protein R87 in PC3 tumors expressing nectin-4 (upper graph) and effects of bispecific binding protein h24 in PC3 tumors without mesothelin expression (lower graph).

Figure 21:
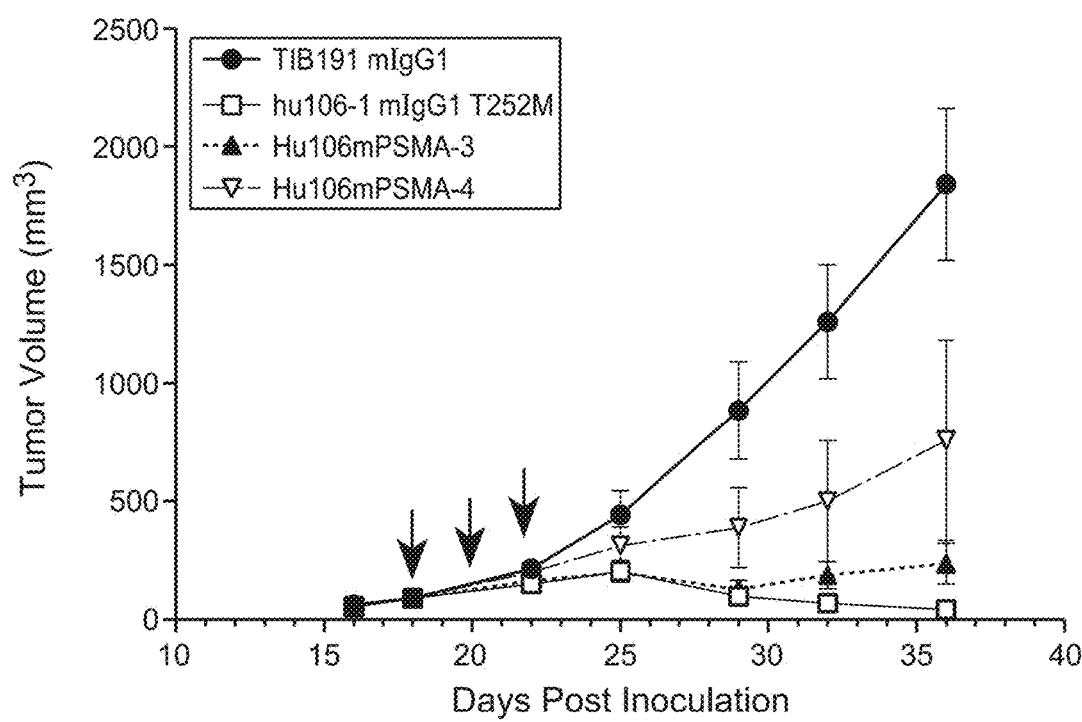

FIG. 21 depicts effects of repeat dosing of an anti-4-1BB antibody, an anti-4-1BB anti-PSMA binding protein, or isotype control on tumor volume in syngeneic immunocompetent Balb/c mice bearing CT26-PSMA tumors. Anti-4-1BB antibody hu106-1 with muIgG1 constant region and T252M mutation ("hu106-1 mIgG1 T252M"), bispecific binding proteins Hu106mPSMA-3 or Hu106mPSMA-4, or isotype control TIB191 mIgG1 was administered three times total. Dosing was performed on days 18, 20, and 22 post-inoculation as indicated by arrows. Y-axis shows tumor volume in mm³, x-axis shows days post-inoculation.

Figure 22A:
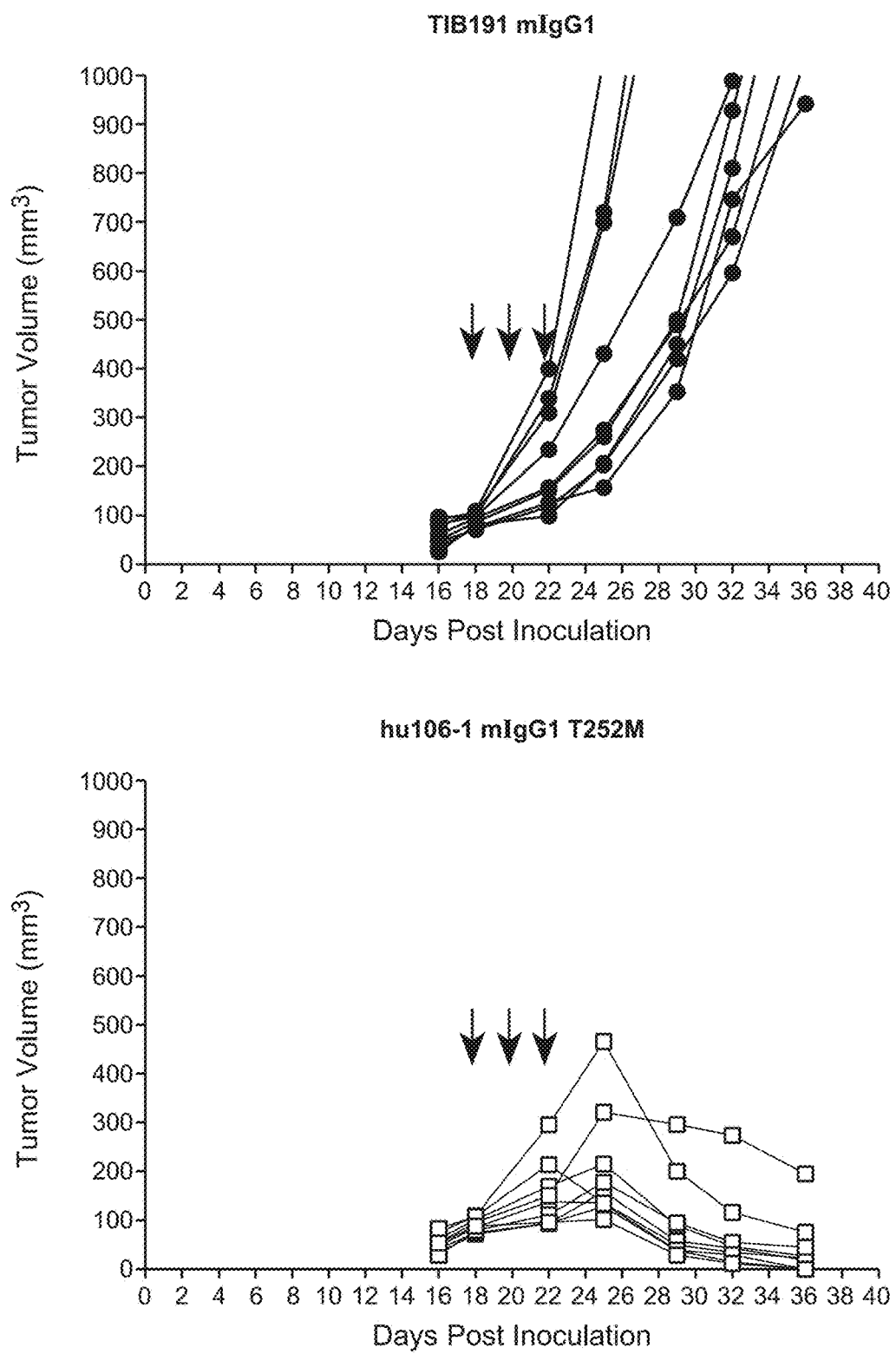
Figure 22B:
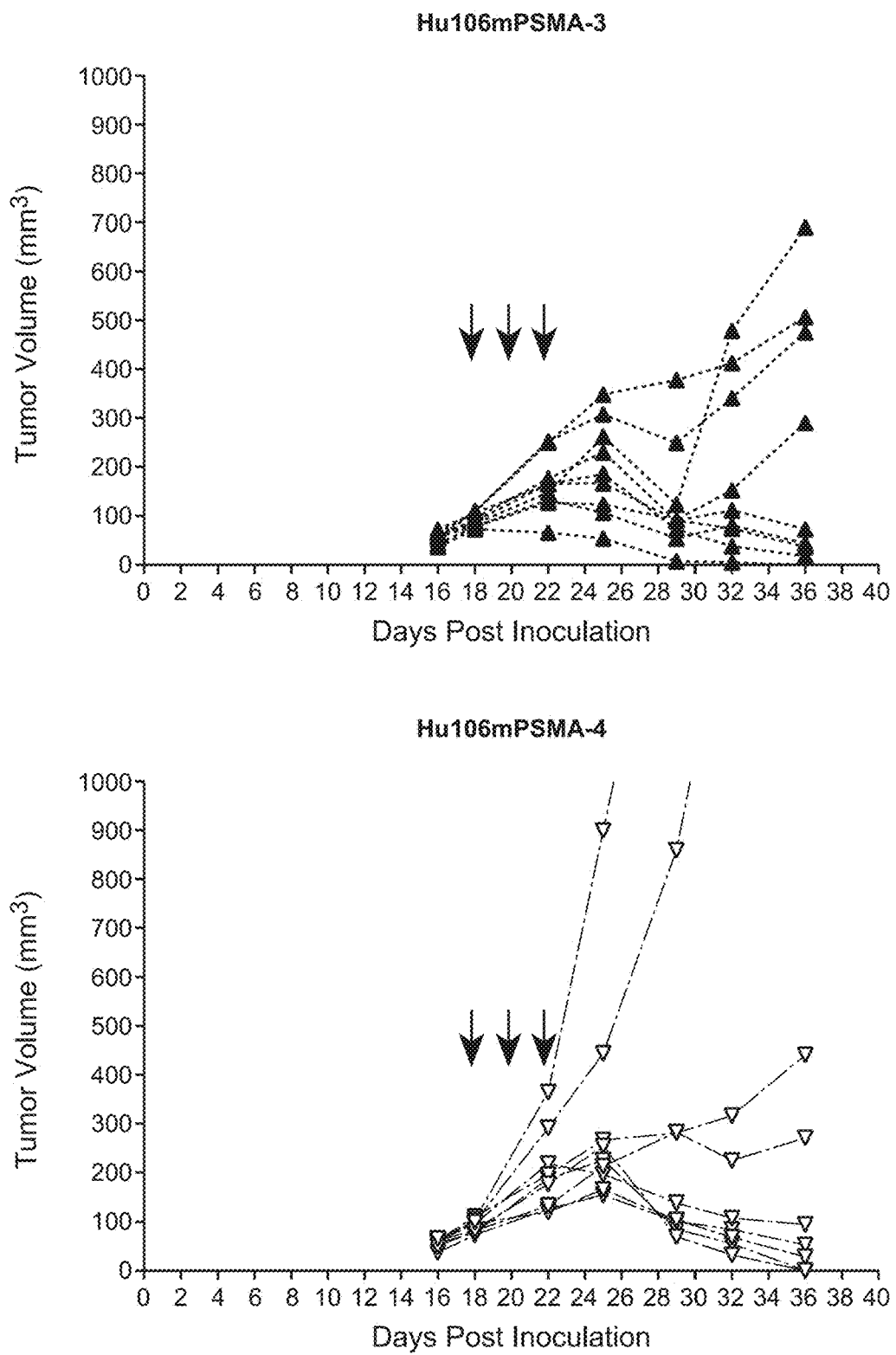

FIGS. 22A and 22B depict tumor volumes in individual animals after repeat dosing of an anti-4-1BB antibody, an anti-4-1BB anti-PSMA binding protein, or isotype control in syngeneic immunocompetent Balb/c mice bearing CT26-PSMA tumors. FIG. 22A shows data in animals dosed with TIB191 mIgG1 (upper graph) and anti-4-1BB antibody hu106-1 mIgG1 T252M (lower graph). FIG. 22B shows data in animals dosed with anti-4-1BB anti-PSMA binding proteins Hu106mPSMA-3 (upper graph) and Hu106mPSMA-4 (lower graph). Dosing was performed on days 18, 20, and 22 post-inoculation as indicated by arrows. Y-axis shows tumor volume in mm³, x-axis shows days post-inoculation.

Figure 23A:
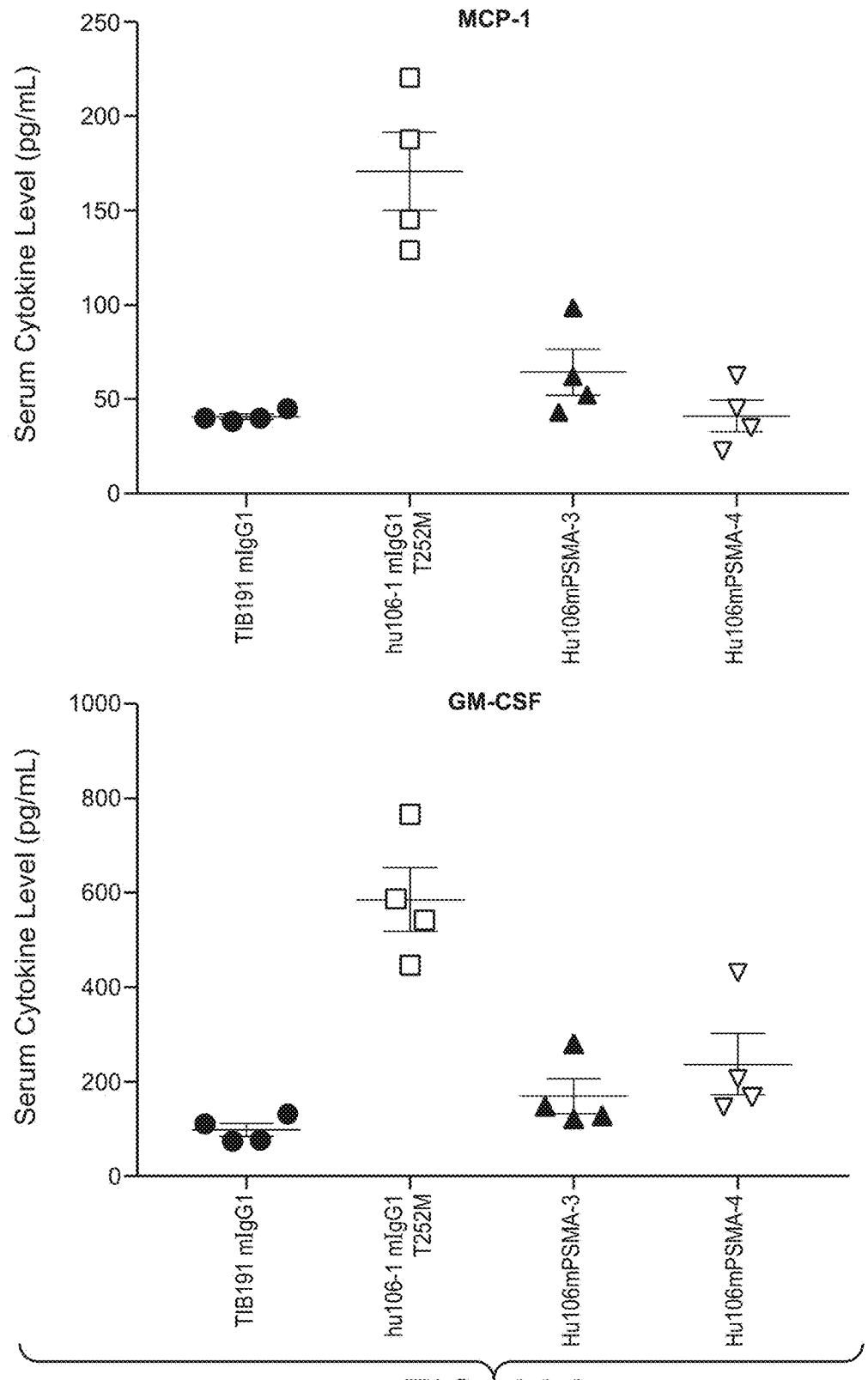
Figure 23B:
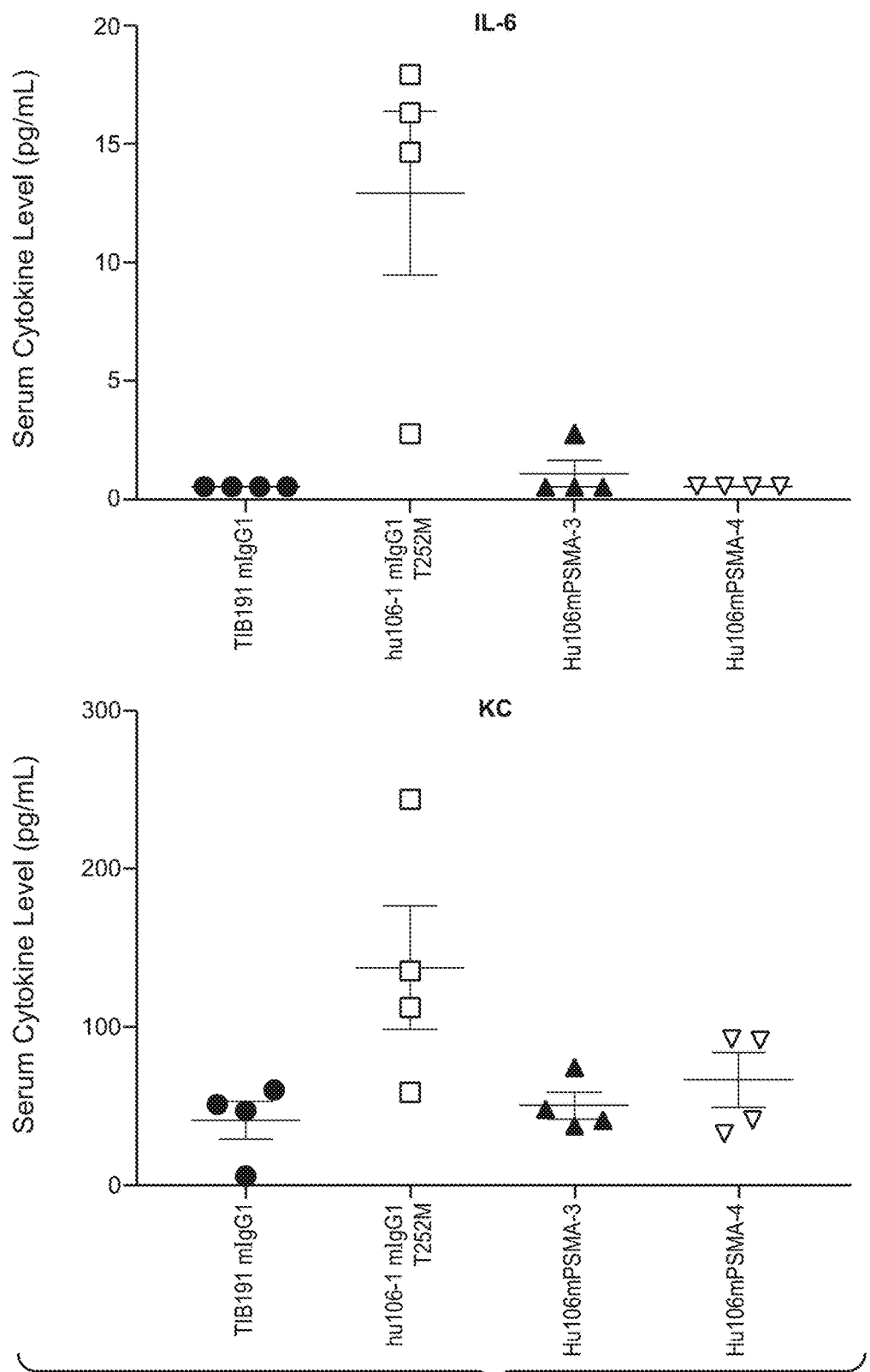

FIGS. 23A and 23B depict serum cytokine levels after repeat dosing of an anti-4-1BB antibody, an anti-4-1BB anti-PSMA binding protein, or isotype control in syngeneic immunocompetent Balb/c mice bearing CT26-PSMA tumors. FIG. 23A shows serum levels of monocyte chemoattractant protein-1 ("MCP-1", upper graph) and granulocyte-macrophage colony-stimulating factor ("GM-CSF", lower graph). FIG. 23B shows serum levels of interleukin-6 ("IL-6", upper graph) and keratinocyte chemoattractant ("KC", lower graph). Y-axis shows serum cytokine level in pg/mL, x-axis shows control antibody TIB191 mIgG1, anti-4-1BB antibody hu106-1 mIgG1 T252M, binding protein Hu106mPSMA-3 or Hu106mPSMA-4.

Figure 23C:
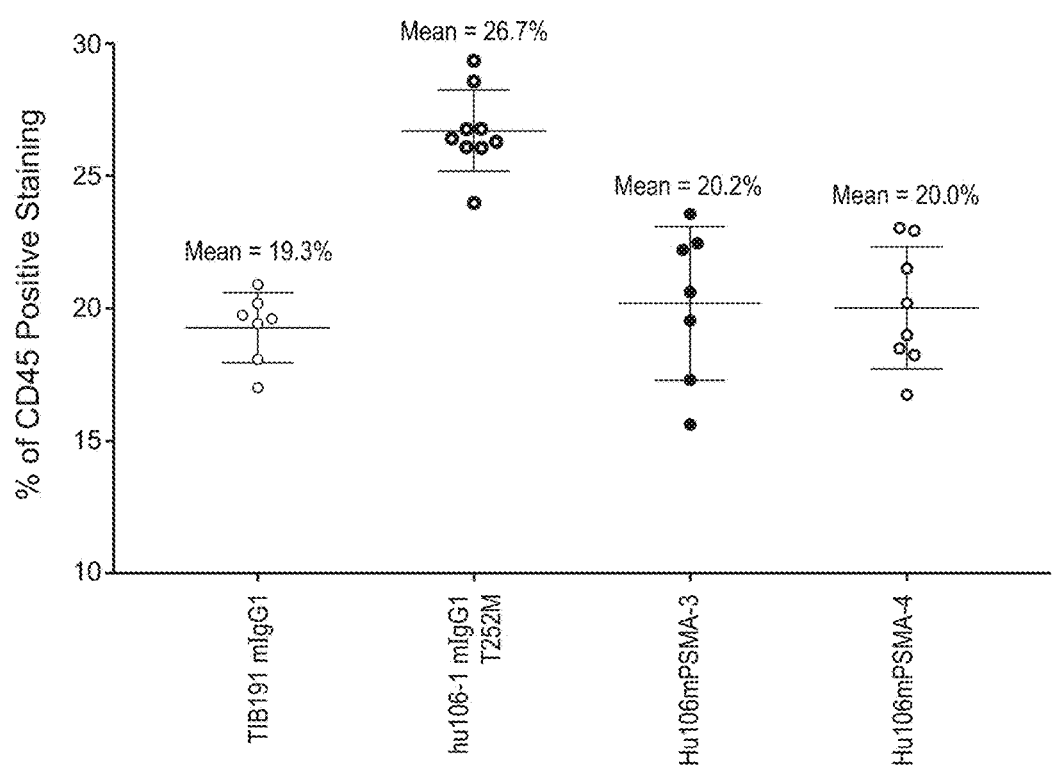

FIG. 23C depicts CD45+ staining in mouse liver samples after repeat dosing of an anti-4-1BB antibody, an anti-4-1BB anti-PSMA binding protein, or isotype control in syngeneic immunocompetent Balb/c mice bearing CT26-PSMA tumors. Y-axis shows % CD45+ staining, x-axis shows control antibody TIB191 mIgG1, anti-4-1BB antibody hu106-1 mIgG1 T252M, binding protein Hu106mPSMA-3 or Hu106mPSMA-4.

7. DETAILED DESCRIPTION

7.1. Abbreviations

The bispecific binding proteins and polynucleotides described herein are, in many embodiments, described by way of their respective polypeptide or polynucleotide sequences. Unless indicated otherwise, polypeptide sequences are provided in N→C orientation; polynucleotide sequences in 5'→3' orientation. For polypeptide sequences, the conventional three or one-letter abbreviations for the genetically encoded amino acids are used, as noted in TABLE 1, below.

TABLE 1

| Encoded Amino Acid Abbreviations | | |
|---|---|---|
| Amino Acid | Three Letter Abbreviation | One-Letter Abbreviation |
| Alanine | Ala | A |
| Arginine | Arg | R |
| Asparagine | Asn | N |
| Aspartic acid | Asp | D |
| Cysteine | Cys | C |
| Glutamic acid | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

Certain sequences are defined by structural formulae specifying amino acid residues belonging to certain classes (e.g., aliphatic, hydrophobic, etc.). The various classes to which the genetically encoded amino acids belong as used herein are noted in TABLE 2, below. Some amino acids may belong to more than one class. Cysteine, which contains a sulfhydryl group, and proline, which is conformationally constrained, are not assigned classes.

TABLE 2

Encoded Amino Acid Classes

| Class | Amino Acids |
| --- | --- |
| Aliphatic | A, I, L, V |
| Aromatic | F, Y, W |
| Non-Polar | M, A, I, L, V |
| Polar | N, Q, S, T |
| Basic | H, K, R |
| Acidic | D, E |
| Small | A, G |

7.2. Definitions

Unless otherwise defined herein, scientific and technical terms used in connection with the present disclosure have the meanings that are commonly understood by those of ordinary skill in the art.

As used herein, numbering of binding protein amino acid residues is done according to Kabat EU nomenclature unless otherwise indicated.

7.3. Bispecific Binding Proteins 7.3.1. Bispecific Formats

Figures 1A, 1B:
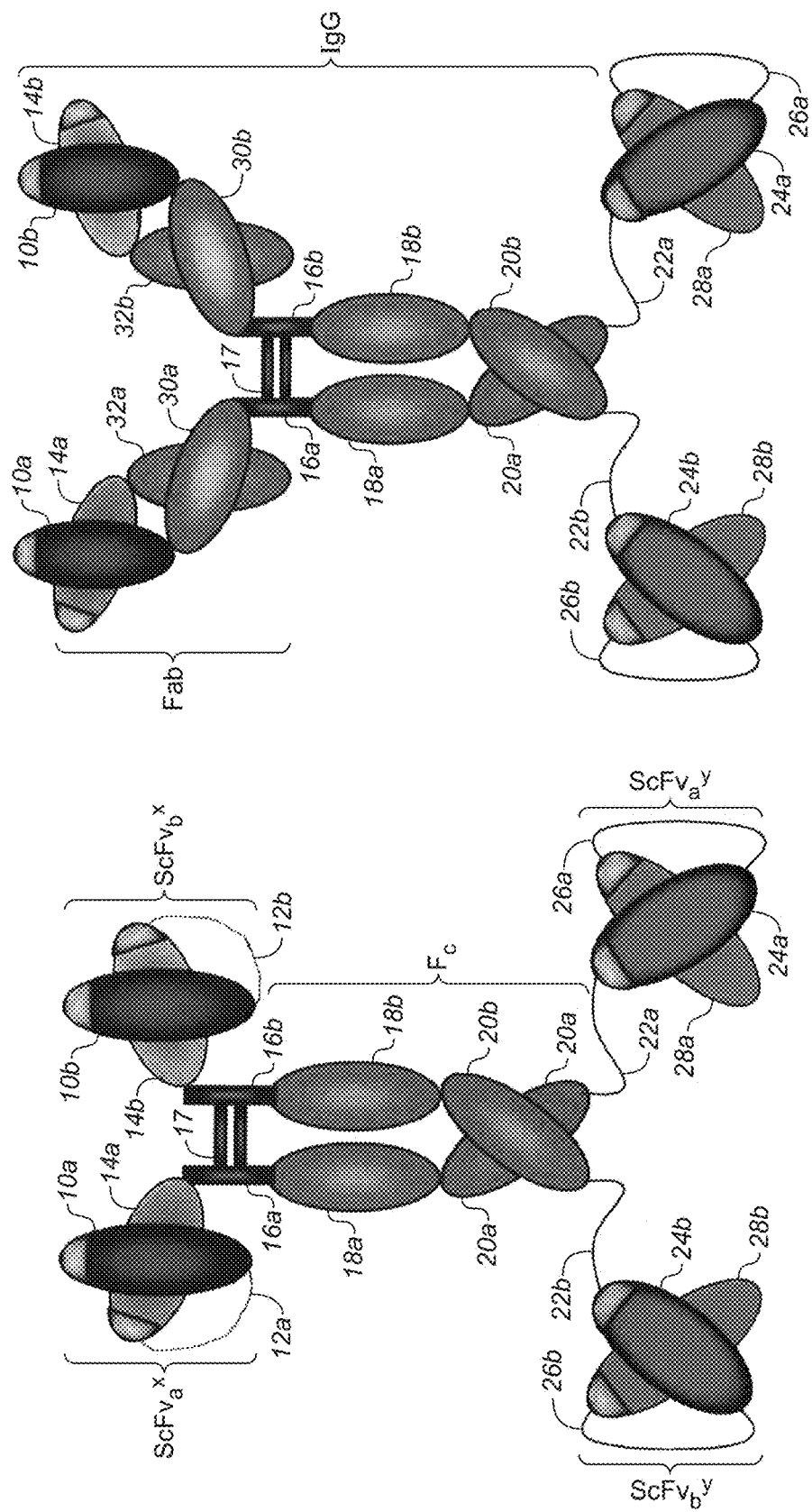

To assist understanding, two exemplary embodiments of bispecific binding proteins are illustrated in FIGS. 1A-1B. With reference to FIG. 1A, one exemplary embodiment comprises two polypeptides linked together via disulfide bonds (17). Each polypeptide comprises a $V_H$ region (10a or 10b) and a respective $V_L$ region (14a or 14b) linked together by a respective polypeptide linker (12a or 12b). Together $V_H$ 10a, $V_L$ 14a and linker 12a constitute a single chain variable fragment (scFv), referred to herein as $scFv_a$. Similarly, $V_H$ 10b, $V_L$ 14b and linker 12b constitute $scFv_b$. The $V_L$ region (14a or 14b) is fused to a hinge region (16a or 16b, respectively), which in turn is fused to an Fc region, which comprises a CH2 domain (18a or 18b, respectively) fused to a CH3 domain (20a or 20b, respectively). The $scFv_a^X$ or $scFv_b^X$ regions may bind to the same or different antigens but in many embodiments bind the same antigen. As illustrated, $scFv_a^X$ and $scFv_b^X$ specifically bind to a first antigen (antigen X).

The binding protein in FIG. 1A comprises a second scFv, $scFv^Y$, which comprises a second $V_L$ region (24a or 24b) (i.e., $V_L^Y$) and a second $V_H$ region (28a or 28b, respectively) (i.e., $V_H^Y$) linked together via a variable chain linker (26a or 26b, respectively). Together $V_H$ 28a, variable chain linker 26a, and $V_L$ 24a constitute a scFv, $scFv_a^Y$, attached via linker 22a to the C-terminal end of CH3 domain 20a. Similarly, $V_H$ 28b, variable chain linker 26b, and $V_L$ 24b constitute $scFv_b^Y$ attached by linker 22b at the C-terminus of CH3 domain 20b. The two moieties $scFv_a^Y$ and $scFv_b^Y$ may bind to the same or different antigens but in many embodiments bind the same antigen. In some embodiments, $scFv_a^Y$ and $scFv_b^Y$ specifically bind a second antigen (antigen Y).

Referring to FIG. 1B, another exemplary embodiment comprises an IgG linked at the C-terminal end of each CH3 domain 20a or 20b to a respective scFv via linker 22a or 22b. The IgG portion comprises two $V_H$ (10a or 10b) and two $V_L$ (14a or 14b) domains, each attached to their corresponding CH1 (30a or 30b) and CL (32a or 32b) regions. As is known in the art, an IgG CH1 region (30a or 30b) is attached to a corresponding hinge (16a or 16b, respectively), which is fused to an Fc region, which comprises a CH2 domain (18a or 18b) fused to a CH3 domain (20a or 20b). At each of the C-termini of CH3 domains 20a or 20b is a linker 22a or 22b, respectively, linking to $V_L$ 24a or 24b of the scFv. The $V_L$ 24a or 24b is then linked via linker 26a or 26b to $V_H$ 28a or 28b, respectively.

CH1 regions 30a and 30b, and CL regions 32a and 32b that compose the Fab domain may independently be $IgG_1$, $IgG_2$, or $IgG_4$ regions. CH1 regions 30a and 30b can be the same or different, but in many embodiments are the same. Similarly, CL regions 32a and 32b can be the same or different, but in many embodiments are the same.

The linkers 12a or 12b linking their respective $V_L$ and $V_H$ regions may the same or different, but in most embodiments are the same. Likewise, linkers 26a or 26b may be the same or different, but in most embodiments are the same, and may be the same as linkers 12a or 12b. In some embodiments, linkers 12a or 12b are the same. In some embodiments, linkers 26a or 26b are the same. Specific sequences for linkers useful for linking $V_H$ and $V_L$ chains are provided in a later section.

As noted above in FIG. 1A, $scFv_a^X$ and $scFv_b^X$ specifically bind a first antigen (antigen X). Binding specificity, as well as affinity, is imparted by $V_H$ chains (10a or 10b) (i.e., $V_H^X$) and $V_L$ chains (14a or 14b, respectively) (i.e., $V_L^X$). In the binding proteins of the disclosure and the specific embodiment depicted in FIG. 1A, the respective CDRs comprising $V_H$ 14a and 14b may be the same or different, as may be the overall $V_H$ chains. In a specific embodiment, $V_H$14a and 14b are the same, and $V_L$ 10a and 10b are the same.

Similarly, $scFv_a^Y$ and $scFv_b^Y$ specifically bind a second antigen (antigen Y). Binding specificity, as well as affinity, is imparted by $V_H$ chains (28a or 28b) (i.e., $V_H^Y$) and $V_L$ chains (24a or 24b, respectively) (i.e., $V_L^Y$). In the binding proteins of the disclosure and the specific embodiments depicted in FIGS. 1A and 1B, the respective CDRs comprising $V_H$ 28a and 28b may be the same or different, as may be the overall $V_H$ chains. In a specific embodiment, $V_H$ 28a and 28b are the same, and $V_L$ 24a and 24b are the same.

As is known in the art, each $V_H$ chain has three complementarity determining regions ("CDRs") referred to herein (in N→C order) as $V_H$ CDR#1, $V_H$ CDR#2, and $V_H$ CDR#3, and each $V_L$ chain has three CDRs referred to herein (in N→C order) as $V_L$ CDR#1, $V_L$ CDR#2, and $V_L$ CDR#3. Specific exemplary CDR, $V_H$ and $V_L$ sequences useful for binding specific antigens of interest are provided in a later section.

The scFv regions that compose the bispecific binding proteins of the disclosure, e.g., a bispecific binding protein of formula (I), comprise $V_H$ and $V_L$ regions that together specifically bind an antigen. The $V_H$ and $V_L$ regions and CDRs incorporated into bispecific binding proteins may be derived from multiple sources, including pre-existing antibodies, newly generated antibodies, $V_H$ and $V_L$ chain libraries, CDR libraries or synthetic sequences. The $V_H$ and $V_L$ chains within a scFv are linked by way of a polypeptide linker that does not significantly interfere with the antigen binding properties of the $V_H$ and $V_L$ regions. The scFv regions can have a $V_H$-$V_L$ or a $V_L$-$V_H$ orientation (in N→C direction), and the orientation can be the same or different between $scFv^X$ and $scFv^Y$. Accordingly, in bispecific binding proteins that comprise an scFv region at both the N- and C-termini, the orientation of the variable chains can be $V_H^X$-$V_L^X$ and $V_L^Y$-$V_H^Y$; $V_H^X$-$V_L^X$ and $V_H^Y$-$V_L^Y$; $V_L^X$-$V_H^X$ and $V_L^Y$-$V_H^Y$; or $V_L^X$-$V_H^X$ and $V_H^Y$-$V_L^Y$. In the example described above and illustrated in FIG. 1A, the bispecific binding protein comprises a polypeptide with a variable chain orientation of $V_H^X$-$V_L^X$ and $V_L^Y$-$V_H^Y$.

Figure 2B:
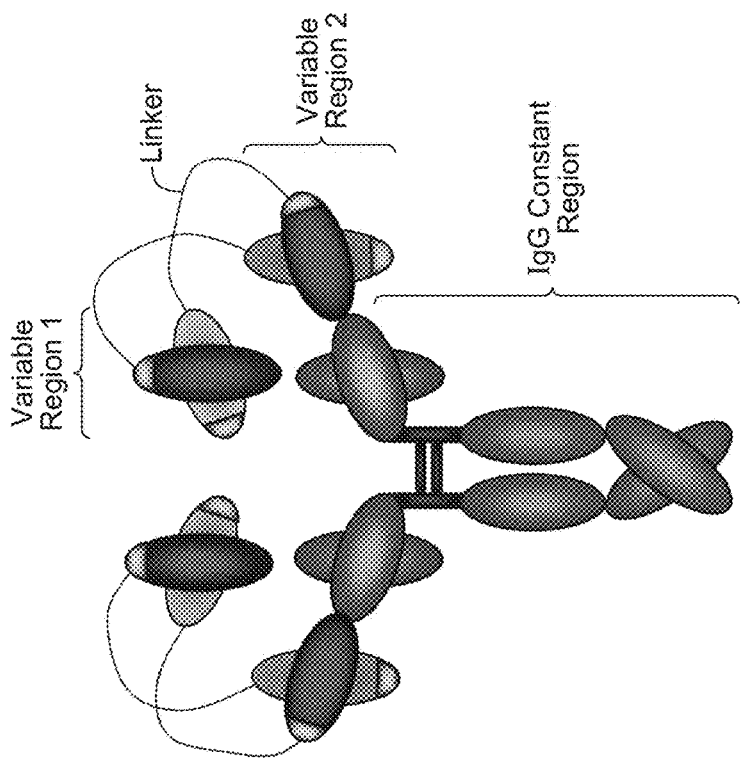
Figure 2A:
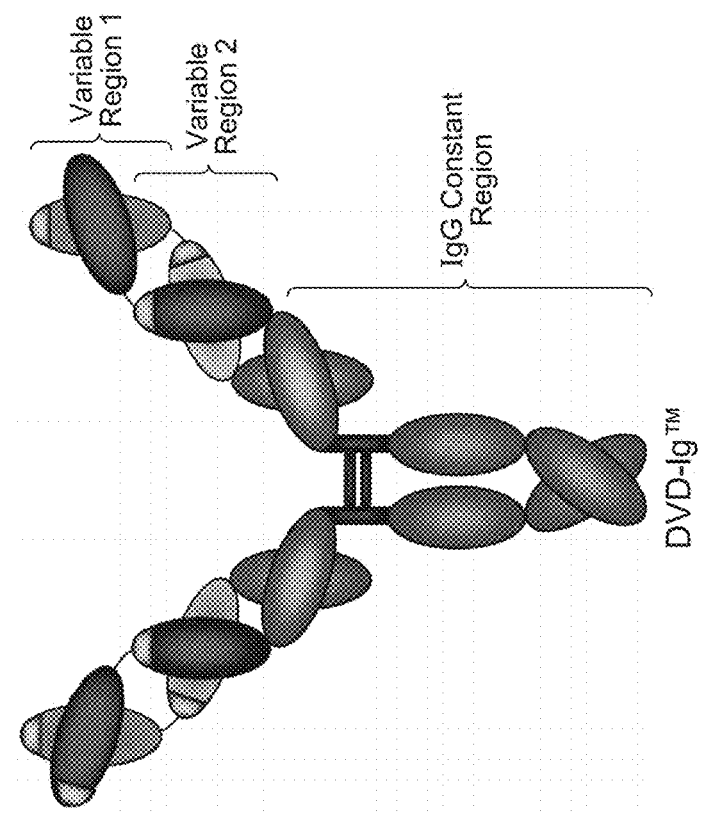

In some embodiments of the disclosure, the bispecific binding proteins exhibit conditional activation, by which they provide activation of an immunomodulatory protein in the presence of a cell-surface tumor antigen, and reduced, minimal or no activation of the immunomodulatory protein in the absence of the cell-surface tumor antigen. In contrast, the bispecific binding proteins shown in FIGS. 2A-2B do not afford conditional activation. FIG. 2A depicts one embodiment in the dual variable domain immunoglobulin (DVD-Ig) format, in which the two variable regions 1 and 2, specifically binding to two antigens, are linked in tandem prior to fusion to an IgG constant region. FIG. 2B shows a bispecific protein of the crossover dual variable domain (CO-DVD) format, in which the variable regions 1 and 2, that bind specifically to two antigens, are linked in tandem by a longer linker region and are also fused to an IgG constant region.

In some embodiments, a bispecific binding protein of the disclosure comprises a linker linking the single chain variable fragment $V_H$ chain with the $V_L$ chain, the linker independently in each instance having a sequence corresponding to a sequence selected from one of the sequences in the table below:

| Sequence (N→C) | Identifier |
| --- | --- |
| GGGGSGGGGSGGGGS | SEQ ID NO: 301 |
| GGGGSGGGGSGGGGSGGGGS | SEQ ID NO: 302 |
| GGGGSGGGGSGGGGSGGGGSGGGGS | SEQ ID NO: 303 |
| GGGGSGGGGSGGGGSGGGGSGGGGSGGGGS | SEQ ID NO: 304 |
| GGGGSGGGGSGGGGSGGGGSGGGGSGGGGSGGGGS | SEQ ID NO: 305 |
| GGGGSGGGGSGGGGSGGGGSGGGGSGGGGSGGGGSGGGGS | SEQ ID NO: 306 |

The linker linking the single chain variable fragment $V_H$ chain with the $V_L$ chain may be selected to increase expression, solubility, stability (for example, as measured by lower aggregation levels, lower rate of aggregation, higher melting temperature, and/or longer plasma half-life), and/or titer of a bispecific binding protein of the disclosure.

As is known in the art, hinge regions 16a and 16b connect the variable regions 14a and 14b with the CH2 domains 18a and 18b, respectively. $IgG_1$, $IgG_2$, $IgG_3$ or $IgG_4$ hinge regions may be used, as well as variant hinge regions as is known in the art.

Hinge region variants can be used in the bispecific binding proteins of the disclosure to optimize certain characteristics. In an illustrative example, one or more amino acid substitutions, insertions, and/or deletions within a hinge region of a human $IgG_1$, $IgG_2$, $IgG_3$ or $IgG_4$ can be introduced to reduce the level or rate of fragmentation and/or aggregation. Such modifications have been described, for example, by Cohen, S. L. et al. Journal of the American Chemical Society, 129 (22), 6976-6977 (2007). In a particular embodiment, the bispecific binding protein of the disclosure comprises a variant $IgG_1$, $IgG_2$ or $IgG_4$, for example, an $IgG_1$ or $IgG_2$ hinge region comprising the amino acid substitution C219S and/or C220S. See, US Patent Appl. No. 2010/0226925. In another embodiment, the bispecific binding protein comprises an $IgG_4$ hinge region comprising the amino acid substitution S228P.

As used herein, the "constant region" includes the natural constant region of an antibody and allotypes or natural variants, such as D356E and L358M, or A431G in human $IgG_1$. See, e.g., Jefferis and Lefranc, MAbs, 1(4): 332-338 (July-August 2009). The light constant region may be a kappa (κ) light region or a lambda (λ) region. A λ light region can be any one of the known subtypes, e.g., $λ_1$, $λ_2$, $λ_3$, or $λ_4$. In some embodiments, the λ light region has a C-terminal residue truncation as compared to the corresponding wild type sequence. See, e.g., Shen et al., MAbs, 5(3): 418-431 (May-June 2013). In some embodiments, the anti-CD40 antibody comprises a kappa (κ) light region.

As is standard in a fragment crystallizable (Fc) region of an IgG, CH2 domains 18a and 18b are fused with their respective CH3 domains 20a and 20b. CH3 regions from $IgG_1$, $IgG_2$, or $IgG_4$ constant regions may be used, as well as variant constant regions as is known in the art, and can be the same or different, but in many embodiments are the same.

An exemplary constant region variant corresponds to "mutant 3" (shown in FIG. 4 of U.S. Pat. No. 5,834,597) in which residues 234 and 237 (using EU numbering) are substituted with alanines. A mutant 3 (also known as "M3") variant can be used in a number of isotypes, e.g., $IgG_2$.

Another exemplary constant region variant corresponds to S228P, i.e., in which a serine residue is substituted with proline, can be used for $IgG_4$. See, Angal, S. et al. Molecular Immunology, 30, 105-108 (1993) and Bloom, J. W. et al. Protein Science, 6: 407-514 (1997).

The bispecific binding proteins of the disclosure may be proteins whose sequences have been modified to alter at least one constant region-mediated biological effector function. For example, in some embodiments, a bispecific binding protein may be modified to reduce at least one constant region-mediated biological effector function relative to the unmodified binding protein, e.g., reduced binding to the Fc receptor (FcγR). FcγR binding may be reduced by mutating the immunoglobulin constant region segment of the binding protein at particular regions necessary for FcγR interactions (See, e.g., Canfield and Morrison, 1991, J. Exp. Med. 173:1483-1491; and Lund et al., 1991, J. Immunol. 147: 2657-2662). Reducing FcγR binding may also reduce other effector functions which rely on FcγR interactions, such as opsonization, phagocytosis and antigen-dependent cellular cytotoxicity ("ADCC").

The bispecific binding proteins of the disclosure can comprise modified (or variant) CH2 domains or entire Fc domains that include amino acid substitutions that increase binding to FcγRIIB and/or reduced binding to FcγRIIIA as compared to the binding of a corresponding wild-type CH2 or Fc region. A binding protein of the disclosure can be a monomer or multimer (e.g., dimer or tetramer), each monomeric unit comprising one or more CH2 or Fc domains. Variant CH2 or variant Fc domains have been described, for example, in U.S. Pat. App. No. 2014/0377253. A variant CH2 or variant Fc domain typically includes one or more substitutions at position 263, position 266, position 273, and position 305, wherein the numbering of the residues in the Fc domain is that of the EU index as in Kabat. In some embodiments, the bispecific binding proteins comprise one or more substitutions selected from V263L, V266L, V273C, V273E, V273F, V273L, V273M, V273S, V273Y, V305K, and V305W, relative to the wild-type CH2 domain. In specific embodiments, the one or more substitutions of the CH2 domain are selected from V263L, V273E, V273F, V273M, V273S, and V273Y, relative to the CH2 domain of a human $IgG_1$. For example, the one or more substitutions of an IgG$_1$ CH2 domain can be V273E. In another specific embodiment, the bispecific binding protein of the disclosure comprises a variant IgG$_1$ CH2 domain comprising the amino acid substitution V263L.

Other examples of variant CH2 or variant Fc domains that can increase binding to FcγRIIB and/or reduce binding to FcγRIIIA as compared to the binding of a corresponding wild-type CH2 or Fc region include those found in Vonderheide, et al. Clin. Cancer Res., 19(5), 1035-1043 (2013), such as S267E or S267E/L328F.

The bispecific binding proteins of the disclosure may include modifications that increase or decrease their binding affinities to the neonatal Fc receptor, FcRn, for example, by mutating the immunoglobulin constant region segment at particular regions involved in FcRn interactions (see, e.g., WO 2005/123780). In particular embodiments, a bispecific binding protein of the IgG class is mutated such that at least one of amino acid residues 250, 314, and 428 of the heavy chain constant region is substituted alone, or in any combinations thereof, such as at positions 250 and 428, or at positions 250 and 314, or at positions 314 and 428, or at positions 250, 314, and 428, with substitution at positions 250 and 428 being a specific combination. For position 250, the substituting amino acid residue may be any amino acid residue other than threonine, including, but not limited to, alanine, cysteine, aspartic acid, glutamic acid, phenylalanine, glycine, histidine, isoleucine, lysine, leucine, methionine, asparagine, proline, glutamine, arginine, serine, valine, tryptophan, or tyrosine. For position 314, the substituting amino acid residue may be any amino acid residue other than leucine, including, but not limited to, alanine, cysteine, aspartic acid, glutamic acid, phenylalanine, glycine, histidine, isoleucine, lysine, methionine, asparagine, proline, glutamine, arginine, serine, threonine, valine, tryptophan, or tyrosine. For position 428, the substituting amino acid residues may be any amino acid residue other than methionine, including, but not limited to, alanine, cysteine, aspartic acid, glutamic acid, phenylalanine, glycine, histidine, isoleucine, lysine, leucine, asparagine, proline, glutamine, arginine, serine, threonine, valine, tryptophan, or tyrosine. An exemplary substitution known to modify Fc effector function is the Fc substitution M428L, which can occur in combination with the Fc substitution T250Q. Additional specific combinations of suitable amino acid substitutions are identified in Table 1 of U.S. Pat. No. 7,217,797. Such mutations increase binding to FcRn, which protects the bispecific binding protein from degradation and increases its half-life.

Polypeptide linkers 22a and 22b linking the CH3 domains 20a and 20b with their respective variable chains 24a and 24b may be selected to fuse the constant region to scFv$^Y$, and can be the same or different, but in most embodiments are the same. The linker linking the CH3 domain in the Fc region with a variable region comprising a single chain variable fragment may be selected to increase expression, solubility, stability (for example, as measured by lower fragmentation levels, lower fragmentation rate, lower aggregation levels, lower rate of aggregation, higher melting temperature, and/or longer plasma half-life), and/or titer of a bispecific binding protein of the disclosure. Linkers linking an Fc region to other functional portions of a polypeptide are disclosed, for example, in US Patent Appl. No. 2014/0044711. Illustrative linkers are known in the art, for example, in Shan, J. et al. Journal of Immunology 1999; 162:6589-6595.

In some embodiments, a bispecific binding protein of the disclosure comprises a linker linking the Fc region with a variable region, the linker having a sequence corresponding to a sequence selected from one of the sequences in the table below:

| Sequence (N→C) | Identifier |
|---|---|
| VDGASSPVNVSSPSVQDI | SEQ ID NO: 251 |
| VDGASSPVNVGSPSVQDI | SEQ ID NO: 253 |
| GASSPVNVSSPSV | SEQ ID NO: 254 |
| GGGGSGGGNGTGSGGGGS | SEQ ID NO: 255 |
| LSAGGHGGLDNDTSAFHL | SEQ ID NO: 256 |
| SDKTHTSPPSPAPESSGG | SEQ ID NO: 257 |
| VTTTDFQIQTEMAATMET | SEQ ID NO: 258 |
| DFLPTTAQPTKKSTLKKR | SEQ ID NO: 259 |
| TESRSPPAENEVSTPMQA | SEQ ID NO: 260 |
| GGGGSGGGNGSGSGGGGS | SEQ ID NO: 261 |
| GGGGSGGGSGGGSGGGGS | SEQ ID NO: 262 |

In some embodiments, a bispecific binding protein comprises two polypeptides of formula (I):

$$X\text{—}H\text{—}Fc\text{—}L\text{—}scFv^Y \qquad (I),$$

wherein
X is scFv$^X$ or a Fab region, wherein X specifically binds a first antigen and scFv$^Y$ specifically binds a second antigen,
H is a hinge region,
Fc comprises CH2 and CH3 regions of an immunoglobulin,
scFv$^X$ and scFv$^Y$ are each independently a single chain variable fragment, and
L is a polypeptide linker.

In some embodiments, one of the two antigens is an immunomodulatory protein and the other is a tumor antigen. In some embodiments, when X is a Fab region, then the first antigen is a tumor antigen, and the second antigen is an immunomodulatory protein. In other embodiments, when X is a Fab region, then the first antigen is an immunomodulatory protein, and the second antigen is a tumor antigen. In some embodiments, L has an amino acid sequence of any one of SEQ ID NOS:251 and 253-262.

In some embodiments, X is scFv$^X$. In other embodiments, X is a Fab region.

In some embodiments, scFv$^X$ has the structure of formula (V) or (VI):

$$V_H^X\text{—}L^X\text{—}V_L^X\text{—} \qquad (V),$$

$$V_L^X\text{—}L^X\text{—}V_H^X\text{—} \qquad (VI),$$

wherein $V_H^X$ is a variable heavy chain, $V_L^X$ is a variable light chain, and $L^X$ is a polypeptide linker. In some embodiments, $L^X$ has an amino acid sequence of any one of SEQ ID NOS: 301-306.

In some embodiments, scFv$^Y$ has the structure of formula (VII) or (VIII):

$$\text{—}V_L^Y\text{—}L^Y\text{—}V_H^Y \qquad (VII),$$

$$\text{—}V_H^Y\text{—}L^Y\text{—}V_L^Y \qquad (VIII),$$

wherein $V_H^Y$ is a variable heavy chain, $V_L^Y$ is a variable light chain, and $L^Y$ is a polypeptide linker. In some embodiments, $L^Y$ has an amino acid sequence of any one of SEQ ID NOS: 301-306.

In some embodiments, the bispecific binding protein of formula (I) comprises two polypeptides of formula (II), two polypeptides of formula (III), or two polypeptides of formula (IV) as described below.

In an embodiment, provided herein is a polypeptide of formula (II):

   (II), wherein L is a polypeptide linker,
H is a hinge region,
Fc comprises CH2 and CH3 regions of an immunoglobulin,
$scFv^X$ and $scFv^Y$ are each independently a single chain variable fragment,
$scFv^X$ specifically binds a first antigen,
$scFv^Y$ specifically binds a second antigen, and
one of the two antigens is an immunomodulatory protein and the other is a tumor antigen.

In some embodiments, L has an amino acid sequence of any one of SEQ ID NOS:251 and 253-262.

In some embodiments, $scFv^X$ has the structure of formula (V) or (VI):

   (V),

   (VI), wherein $V_H^X$ is a variable heavy chain, $V_L^X$ is a variable light chain, and $L^X$ is a polypeptide linker. In some embodiments, $L^X$ has an amino acid sequence of any one of SEQ ID NOS: 301-306.

In some embodiments, $scFv^Y$ has the structure of formula (VII) or (VIII):

   (VII),

   (VIII), wherein $V_H^Y$ is a variable heavy chain, $V_L^Y$ is a variable light chain, and $L^Y$ is a polypeptide linker. In some embodiments, $L^Y$ has an amino acid sequence of any one of SEQ ID NOS: 301-306.

In another aspect, provided is a polypeptide of formula (III):

   (III), wherein
L is a polypeptide linker,
H is a hinge region,
Fc comprises CH2 and CH3 regions of an immunoglobulin,
Fab is a fragment antigen-binding region,
$scFv^Y$ is a single chain variable fragment,
Fab specifically binds a first antigen, and
$scFv^Y$ specifically binds a second antigen.

In some embodiments, the first antigen is a tumor antigen and the second antigen is an immunomodulatory protein. In some embodiments, the first antigen is an immunomodulatory protein and the second antigen is a tumor antigen. In some embodiments, L has an amino acid sequence of any one of SEQ ID NOS:251 and 253-262.

In some embodiments, $scFv^Y$ has the structure of formula (VII) or (VIII):

   (VII),

   (VIII), wherein $V_H^Y$ is a variable heavy chain, $V_L^Y$ is a variable light chain, and $L^Y$ is a polypeptide linker. In some embodiments, $L^Y$ has an amino acid sequence of any one of SEQ ID NOS: 301-306.

In another aspect is provided a polypeptide of formula (IV):

   (IV), wherein
L is a polypeptide linker, $V_H$—CH1, when combined with a peptide comprising $V_L$—CL, specifically binds a first antigen,
CH1 is a CH1 constant domain,
CL is a light chain constant domain,
$V_H$ is a variable heavy chain,
$V_L$ is a variable light chain,
H is a hinge region,
Fc comprises CH2 and CH3 regions of an immunoglobulin,
$scFv^Y$ is a single chain variable fragment, and
$scFv^Y$ specifically binds a second antigen.

In some embodiments, the first antigen is a tumor antigen and the second antigen is an immunomodulatory protein. In some embodiments, the first antigen is an immunomodulatory protein and the second antigen is a tumor antigen. In some embodiments, L has an amino acid sequence of any one of SEQ ID NOS:251 and 253-262.

In some embodiments, $scFv^Y$ has the structure of formula (VII) or (VIII):

   (VII),

   (VIII), wherein $V_H^Y$ is a variable heavy chain, $V_L^Y$ is a variable light chain, and $L^Y$ is a polypeptide linker. In some embodiments, $L^Y$ has an amino acid sequence of any one of SEQ ID NOS: 301-306.

The bispecific binding proteins of the disclosure can comprise fragments or portions of monoclonal antibodies, genetically engineered, and/or otherwise modified in nature, including but not limited to, chimeric antibodies, humanized antibodies, human antibodies, etc. In various embodiments, the binding proteins comprise all or a portion of a constant region of an immunoglobulin. In some embodiments, the constant region is an isotype selected from: IgA (e.g., $IgA_1$ or $IgA_2$), IgD, IgE, IgG (e.g., $IgG_1$, $IgG_2$, $IgG_3$ or $IgG_4$), and IgM. In some embodiments, a bispecific binding protein comprises one or more constant regions from one or more isotypes. In an illustrative example, a bispecific binding protein can comprise a hinge and a CH2 region from $IgG_1$, and a CH3 region from $IgG_4$. In specific embodiments, the bispecific binding proteins of the disclosure comprise an $IgG_1$, $IgG_2$, or $IgG_4$ constant region.

The bispecific binding proteins of the disclosure may be derivatized. Derivatized binding proteins are typically modified by glycosylation, acetylation, pegylation, phosphorylation, amidation, derivatization by known protecting/blocking groups, proteolytic cleavage, linkage to a cellular ligand or other protein. Any of numerous chemical modifications may be carried out by known techniques, including, but not limited to, specific chemical cleavage, acetylation, formylation, metabolic synthesis of tunicamycin, etc. Additionally, the derivative may contain one or more non-natural amino acids. See, e.g., Wolfson, 2006, Chem. Biol. 13(10):1011-2.

A bispecific binding protein of the disclosure may have one or more amino acids inserted into one or more of its CDR regions, for example as described in Jung & Plückthun, 1997, Protein Engineering 10:9, 959-966; Yazaki et al., 2004, Protein Eng. Des Sel. 17(5):481-9; and U.S. Pat. App. No. 2007/0280931.

In some embodiments, the bispecific binding protein comprises an amino acid sequence shown in FIGS. 8A-8H. In some embodiments, the bispecific binding protein comprises an amino acid sequence of any one of SEQ ID NOS: 401, 402, 403, 404, 405, 406, 407, 408, 409, 410, 411, 412, 419, 420, and 421. In some embodiments, the bispecific binding protein comprises an amino acid sequence of SEQ ID NO: 401. In some embodiments, the bispecific binding protein comprises an amino acid sequence of SEQ ID NO: 402. In some embodiments, the bispecific binding protein comprises an amino acid sequence of SEQ ID NO: 403. In some embodiments, the bispecific binding protein comprises an amino acid sequence of SEQ ID NO: 404. In some embodiments, the bispecific binding protein comprises an amino acid sequence of SEQ ID NO: 405. In some embodiments, the bispecific binding protein comprises an amino acid sequence of SEQ ID NO: 406. In some embodiments, the bispecific binding protein comprises an amino acid sequence of SEQ ID NO: 407. In some embodiments, the bispecific binding protein comprises an amino acid sequence of SEQ ID NO: 408. In some embodiments, the bispecific binding protein comprises an amino acid sequence of SEQ ID NO: 409. In some embodiments, the bispecific binding protein comprises an amino acid sequence of SEQ ID NO: 410. In some embodiments, the bispecific binding protein comprises an amino acid sequence of SEQ ID NO: 411. In some embodiments, the bispecific binding protein comprises an amino acid sequence of SEQ ID NO: 412. In some embodiments, the bispecific binding protein comprises an amino acid sequence of SEQ ID NO: 419. In some embodiments, the bispecific binding protein comprises an amino acid sequence of SEQ ID NO: 420. In some embodiments, the bispecific binding protein comprises an amino acid sequence of SEQ ID NO: 421.

In some embodiments, the bispecific binding protein comprises an amino acid sequence shown in FIGS. 8I-8M. In some embodiments, the bispecific binding protein comprises an amino acid sequence of any one of SEQ ID NOS: 431-440. In some embodiments, the bispecific binding protein comprises an amino acid sequence of SEQ ID NO: 431. In some embodiments, the bispecific binding protein comprises an amino acid sequence of SEQ ID NO: 432. In some embodiments, the bispecific binding protein comprises an amino acid sequence of SEQ ID NO: 433. In some embodiments, the bispecific binding protein comprises an amino acid sequence of SEQ ID NO: 434. In some embodiments, the bispecific binding protein comprises an amino acid sequence of SEQ ID NO: 435. In some embodiments, the bispecific binding protein comprises an amino acid sequence of SEQ ID NO: 436. In some embodiments, the bispecific binding protein comprises an amino acid sequence of SEQ ID NO: 437. In some embodiments, the bispecific binding protein comprises an amino acid sequence of SEQ ID NO: 438. In some embodiments, the bispecific binding protein comprises an amino acid sequence of SEQ ID NO: 439. In some embodiments, the bispecific binding protein comprises an amino acid sequence of SEQ ID NO: 440.

In some embodiments, the bispecific binding protein comprises an amino acid sequence shown in FIGS. 10B-10D. In some embodiments, the bispecific binding protein comprises an amino acid sequence of any one of SEQ ID NOS: 413-418. In some embodiments, the bispecific binding protein comprises an amino acid sequence of SEQ ID NO: 413. In some embodiments, the bispecific binding protein comprises an amino acid sequence of SEQ ID NO: 414. In some embodiments, the bispecific binding protein comprises an amino acid sequence of SEQ ID NO: 415. In some embodiments, the bispecific binding protein comprises an amino acid sequence of SEQ ID NO: 416. In some embodiments, the bispecific binding protein comprises an amino acid sequence of SEQ ID NO: 417. In some embodiments, the bispecific binding protein comprises an amino acid sequence of SEQ ID NO: 418.

In some embodiments, the bispecific binding protein comprises an amino acid sequence shown in FIGS. 10H-10I. In some embodiments, the bispecific binding protein comprises an amino acid sequence of any one of SEQ ID NOS: 441-444. In some embodiments, the bispecific binding protein comprises an amino acid sequence of SEQ ID NO: 441. In some embodiments, the bispecific binding protein comprises an amino acid sequence of SEQ ID NO: 442. In some embodiments, the bispecific binding protein comprises an amino acid sequence of SEQ ID NO: 443. In some embodiments, the bispecific binding protein comprises an amino acid sequence of SEQ ID NO: 444.

In some embodiments, the bispecific binding protein comprises an amino acid sequence shown in FIG. 10L. In some embodiments, the bispecific binding protein comprises an amino acid sequence of SEQ ID NO: 445. In some embodiments, the bispecific binding protein comprises an amino acid sequence of SEQ ID NO: 446.

When a bispecific binding protein comprises a Fab region and an scFv region, the binding protein comprises two polypeptides, e.g., a polypeptide of formula (III), each comprising two amino acid sequences: a light chain, e.g., a peptide comprising $V_L$-CL, covalently bound by a disulfide bridge to a heavy chain, e.g., a polypeptide of formula (IV). In some embodiments, the light chain comprises a kappa light constant region. In other embodiments, the light chain comprises a lambda light constant region. In certain embodiments, the light chain comprises an amino acid sequence of SEQ ID NO: 371 or 372. In some embodiments, the heavy chain sequence comprises an amino acid sequence of any one of SEQ ID NOS: 351-370.

In some embodiments, the bispecific binding protein comprises a light chain according to SEQ ID NO:371 and a heavy chain according to SEQ ID NO:351. In some embodiments, the bispecific binding protein comprises a light chain according to SEQ ID NO:371 and a heavy chain according to SEQ ID NO:352. In some embodiments, the bispecific binding protein comprises a light chain according to SEQ ID NO:371 and a heavy chain according to SEQ ID NO:353. In some embodiments, the bispecific binding protein comprises a light chain according to SEQ ID NO:371 and a heavy chain according to SEQ ID NO:354. In some embodiments, the bispecific binding protein comprises a light chain according to SEQ ID NO:371 and a heavy chain according to SEQ ID NO:355. In some embodiments, the bispecific binding protein comprises a light chain according to SEQ ID NO:371 and a heavy chain according to SEQ ID NO:356. In some embodiments, the bispecific binding protein comprises a light chain according to SEQ ID NO:371 and a heavy chain according to SEQ ID NO:357. In some embodiments, the bispecific binding protein comprises a light chain according to SEQ ID NO:371 and a heavy chain according to SEQ ID NO:358. In some embodiments, the bispecific binding protein comprises a light chain according to SEQ ID NO:371 and a heavy chain according to SEQ ID NO:359. In some embodiments, the bispecific binding protein comprises a light chain according to SEQ ID NO:371 and a heavy chain according to SEQ ID NO:360.

In some embodiments, the bispecific binding protein comprises a light chain according to SEQ ID NO:372 and a heavy chain according to SEQ ID NO:361. In some embodiments, the bispecific binding protein comprises a light chain according to SEQ ID NO:372 and a heavy chain according to SEQ ID NO:362. In some embodiments, the bispecific binding protein comprises a light chain according to SEQ ID NO:372 and a heavy chain according to SEQ ID NO:363. In some embodiments, the bispecific binding protein comprises a light chain according to SEQ ID NO:372 and a heavy chain according to SEQ ID NO:364. In some embodiments, the bispecific binding protein comprises a light chain according to SEQ ID NO:372 and a heavy chain according to SEQ ID NO:365. In some embodiments, the bispecific binding protein comprises a light chain according to SEQ ID NO:372 and a heavy chain according to SEQ ID NO:366. In some embodiments, the bispecific binding protein comprises a light chain according to SEQ ID NO:372 and a heavy chain according to SEQ ID NO:367. In some embodiments, the bispecific binding protein comprises a light chain according to SEQ ID NO:372 and a heavy chain according to SEQ ID NO:368. In some embodiments, the bispecific binding protein comprises a light chain according to SEQ ID NO:372 and a heavy chain according to SEQ ID NO:369. In some embodiments, the bispecific binding protein comprises a light chain according to SEQ ID NO:372 and a heavy chain according to SEQ ID NO:370.

The bispecific binding proteins can bind to two different antigens. In some embodiments, the presence of both antigens are required to effect the desired biological response, e.g., modulation (e.g., an increase or a decrease) of a biochemical signal. In such embodiments, the biological response is effected in a selected biological environment, e.g., a tumor microenvironment, when both antigens are present. In some embodiments, the modulation of a biochemical signal provides a selective biological effect, e.g., activation of the immune system selectively in the tumor microenvironment. In some embodiments, the modulation of a biochemical signal provides a greater avoidance of systemic toxicity.

The bispecific binding proteins described herein generally bind specifically to human antigens. Cross reactive binding to antigens from other species, for example, from mouse or monkey, e.g., cynomolgus monkey, may offer advantages, such as the ability to test in animal models for biological activity. Such animal model testing may be used to screen bispecific binding proteins to select for properties, e.g., favorable pharmacokinetics, relative to biological activity. In some embodiments, the bispecific binding protein binds to a cynomolgus antigen. In some embodiments, the bispecific binding protein binds to a mouse antigen.

In some embodiments, the bispecific binding protein competes for binding in in vitro assays with a reference antibody. The reference antibody can bind a first antigen or a second antigen. In some embodiments, the reference antibody is any one of the antibodies described herein. In some embodiments, the reference antibody is a humanized or human version of an antibody described herein.

Assays for competition include, but are not limited to, a radioactive material labeled immunoassay (RIA), an enzyme-linked immunosorbent assay (ELISA), a sandwich ELISA, fluorescence activated cell sorting (FACS) assays, and surface plasmon resonance assays.

In conducting an antibody competition assay between a reference antibody and a test binding protein (irrespective of species or isotype), one may first label the reference with a detectable label, such as a fluorophore, biotin or an enzymatic (or even radioactive) label to enable subsequent identification. In this case, cells expressing an antigen of interest (i.e., a first antigen or a second antigen) are incubated with unlabeled test binding protein, labeled reference antibody is added, and the intensity of the bound label is measured. If the test binding protein competes with the labeled reference antibody by binding to an overlapping epitope, the intensity will be decreased relative to a control reaction carried out without the test binding protein.

In a specific embodiment of this assay, the concentration of labeled reference antibody that yields 80% of maximal binding ("$conc_{80\%}$") under the assay conditions (e.g., a specified density of cells) is first determined, and a competition assay carried out with 10× $conc_{80\%}$ of unlabeled test binding protein and $conc_{80\%}$ of labeled reference antibody.

Binding inhibition in a competition assay described herein can be expressed as an inhibition constant, or $K_i$, which is calculated according to the following formula:

$$K_i = IC_{50}/(1+[\text{reference } Ab \text{ concentration}]/K_d),$$

where $IC_{50}$ is the concentration of test binding protein that yields a 50% reduction in binding of the reference antibody and $K_d$ is the dissociation constant of the reference antibody, a measure of its affinity for the antigen of interest. Antibodies that compete with binding proteins disclosed herein can have a $K_i$ from 10 pM to 1000 nM under assay conditions described herein.

In various embodiments, a test binding protein is considered to compete with a reference antibody if it decreases binding of the reference antibody by at least about 20% or more, for example, by at least about 20%, 30%, 40%, 50%, 60%, 70%, 80%, 90%, 95% or even more, or by a percentage ranging between any of the foregoing values, at a reference antibody concentration that is 80% of maximal binding under the specific assay conditions used, and a test binding protein concentration that is 10-fold higher than the reference antibody concentration.

A specific assay and assay conditions useful for assessing whether a test binding protein competes for binding an antigen of interest with a reference antibody as described herein is provided in Example 3. Antibody competition can be determined in an analogous manner to the method described for determining 4-1BB ligand competition in Section 8.3.3.3.

As discussed above, a bispecific binding protein of the disclosure can bind to two different antigens, and activate one conditionally in the presence of the other. In one embodiment, the bispecific binding protein binds to an immunomodulatory protein, for example, to activate an immune receptor, and a tumor antigen. In one particular embodiment, the bispecific binding protein agonizes CD40 when bound to the tumor antigen mesothelin, and exhibits reduced CD40 agonizing activity in the absence of mesothelin. In another particular embodiment, the bispecific binding protein agonizes 4-1BB when bound to the tumor antigen mesothelin, and exhibits reduced 4-1BB agonizing activity in the absence of mesothelin. In another particular embodiment, the bispecific binding protein agonizes 4-1BB when bound to the tumor antigen B7-H4, and exhibits reduced 4-1BB agonizing activity in the absence of B7-H4. In such cases, the bispecific binding protein provides for target-specific conditional activation of the immune response in a tumor microenvironment. For example, the bispecific proteins described herein can be used to initiate target-specific conditional activation of an immunological response against tumor cells to treat subjects diagnosed with solid tumors.

Assays to determine conditional activation are known in the art. In an illustrative example with a bispecific protein that binds to an immunomodulatory protein and a tumor antigen, conditional activation may be determined by comparing immunomodulatory protein activity with and without the tumor antigen. In such cases, conditional activation is determined, for example, by an increase in activation in the presence of the tumor antigen compared with its absence. In some embodiments, the immunomodulatory protein activity is at least about 5-fold, such as 6, 7, 8, 9, 10, 12, 15, 18, 20, 25, 30, 40, 50, 70, 80, 100, 200, 400, 500, 700, 800, or 1000-fold or greater increase in activity in the presence of tumor antigen compared with its absence. In some embodiments, the immunomodulatory protein activity is less than about 10000-fold, such as 5000, 2000, 1000, 800, 600, 500, 300, 200 or 100-fold or lower increase in activity in the presence of tumor antigen compared with its absence. In certain embodiments, the assay is an assay described in Section 8.1.2. In other embodiments, the assay is an assay described in Section 8.3.3.

7.3.2. Immunomodulatory Binding Proteins

In some embodiments, the bispecific binding protein of the disclosure, e.g., a bispecific binding protein of formula (I), selectively binds to an immunomodulatory protein selected from a tumor necrosis factor receptor (TNFR) and a CD28 family protein. TNFR superfamily proteins include, but are not limited to, CD27 (S152, Tp55, TNFR superfamily member 7), CD30, CD40 (p50, Bp50), CD95, HVEM (CD270, TNFSF14, TR2, ATAR), 4-1BB (CD137, ILA, TNFR superfamily member 9), TRAILR1 (CD120a, DR4, Apo2, CD261, TNFR superfamily member 10$a$), TRAILR2 (DR5, KILLER, TRICK2A, TRICKB, CD262, TNFR superfamily member 10$b$), TNFR2 (CD120b), and TACI (CD267). The CD28 receptor family members include, but are not limited to, CD28, ICOS, PD-1, and CTLA-4. In one particular embodiment, the immunomodulatory protein is CD40. In another specific embodiment, the immunomodulatory protein is 4-1BB.

In an illustrative embodiment, when the immunomodulatory protein is CD40 and X is scFv$^X$, the bispecific binding protein of formula (I) comprises scFv$^X$ binding CD40 and scFv$^Y$ binding a tumor antigen. In certain embodiments, when the immunomodulatory protein is CD40 and X is scFv$^X$, the bispecific binding protein of formula (I) comprises scFv$^X$ binding a tumor antigen and scFv$^Y$ binding CD40. In certain embodiments, when the immunomodulatory protein is 4-1BB and X is scFv$^X$, the bispecific binding protein of formula (I) comprises scFv$^X$ binding 4-1BB and scFv$^Y$ binding a tumor antigen. In certain embodiments, when the immunomodulatory protein is 4-1BB and X is scFv$^X$, the bispecific binding protein of formula (I) comprises scFv$^X$ binding a tumor antigen and scFv$^Y$ binding 4-1BB. In certain embodiments, when the immunomodulatory protein is CD40 and X is Fab, the bispecific binding protein of formula (I) comprises Fab binding a tumor antigen and scFv$^Y$ binding CD40.

In an illustrative embodiment, when the immunomodulatory protein is CD40, the polypeptide of formula (II) comprises scFv$^X$ binding CD40 and scFv$^Y$ binding a tumor antigen. In certain embodiments, when the immunomodulatory protein is CD40, the polypeptide of formula (II) comprises scFv$^X$ binding a tumor antigen and scFv$^Y$ binding CD40. In certain embodiments, when the immunomodulatory protein is 4-1BB, the polypeptide of formula (II) comprises scFv$^X$ binding 4-1BB and scFv$^Y$ binding a tumor antigen. In certain embodiments, when the immunomodulatory protein is 4-1BB, the polypeptide of formula (II) comprises scFv$^X$ binding a tumor antigen and scFv$^Y$ binding 4-1BB.

In an illustrative embodiment, when the immunomodulatory protein is CD40, the polypeptide of formula (III) comprises Fab binding a tumor antigen and scFv$^Y$ binding CD40. In certain embodiments, when the immunomodulatory protein is 4-1BB, the polypeptide of formula (III) comprises Fab binding a tumor antigen and scFv$^Y$ binding 4-1BB. In certain embodiments, when the immunomodulatory protein is 4-1BB, the polypeptide of formula (III) comprises Fab binding 4-1BB and scFv$^Y$ binding a tumor antigen.

In an illustrative embodiment, when the immunomodulatory protein is CD40, the polypeptide of formula (IV) comprises $V_H$-CH1, when combined with a peptide comprising $V_L$-CL, binding a tumor antigen, and scFv$^Y$ binding CD40. In certain embodiments, when the immunomodulatory protein is 4-1BB, the polypeptide of formula (IV) comprises $V_H$-CH1, when combined with a peptide comprising $V_L$-CL, binding a tumor antigen, and scFv$^Y$ binding 4-1BB. In certain embodiments, when the immunomodulatory protein is 4-1BB, the polypeptide of formula (IV) comprises $V_H$-CH1, when combined with a peptide comprising $V_L$-CL, binding 4-1BB, and scFv$^Y$ binding a tumor antigen.

For some uses, it is desirable to have bispecific binding proteins with affinity to an immunomodulatory protein. For certain uses, such as therapeutic uses, an affinity, e.g., $K_D$, of at least about 3000 nM is desirable. For applications in which specific affinities are desired, bispecific binding proteins specifically bind an immunomodulatory protein with an affinity of at least about 3000 nM, or even higher, for example, at least about 2000 nM, 1000 nM, 900 nM, 800 nM, 700 nM, 600 nM, 500 nM, 400 nM, 300 nM, 250 nM, 200 nM, 150 nM, 100 nM, 90 nM, 80 nM, 70 nM, 60 nM, 50 nM, 40 nM, 30 nM, 25 nM, 20 nM, 15 nM, 10 nM, 7 nM, 6 nM, 5 nM, 4 nM, 3 nM, 2 nM, 1 nM or greater. In some embodiments, the $K_D$ to an immunomodulatory protein is in a range bounded by any two of the foregoing values, e.g., from about 1 to about 5000 nM, such as 10 to 3000, 50 to 3000, 100 to 2000, 1 to 1000, 20 to 2000, 30 to 3000, or about 100 to 3000 nM.

In some embodiments, the bispecific binding proteins compete for binding human CD40 (SEQ ID NO:271) on cells expressing CD40 in in vitro assays with a reference antibody. The reference antibody may be any of the anti-CD40 antibodies described herein or known in the art. In some embodiments, the reference antibody is an antibody provided in TABLE 1-4. In specific embodiments, the reference antibody is selected from antibody AD163.9.3 ("muAb1"); antibody AD166.4.4 ("muAb2"); antibody AD175.14.11 ("muAb3"); antibody AD163.10.7 ("muAb4"); antibody AD165.1.2 ("muAb5"); antibody AD163.162.1 ("muAb6"); antibody AD163.27.12 ("muAb7"); antibody AD163.7.2 ("muAb8"); antibody AD164.14.6 ("muAb9"); and antibody AD164.76.2 ("muAb10"). In some embodiments, the reference antibody is a humanized version of an antibody provided in TABLE 1-4. In some embodiments, the reference antibody is a humanized version of muAb1, muAb1, muAb2, muAb3, muAb4, muAb5, muAb6, muAb7, muAb8, muAb9, or muAb10. In a specific embodiment, the reference antibody is huAb9-5 having a heavy chain according to SEQ ID NO:310 or 311, and a light chain according to SEQ ID NO:320. In another specific embodiment, the reference antibody is huAb9-5 V273E having a heavy chain according to SEQ ID NO:312 or 313, and a light chain according to SEQ ID NO:320. In another specific embodiment, the reference antibody is huAb9-5 V273Y having a heavy chain according to SEQ ID NO:314 or 315, and a light chain according to SEQ ID NO:320. In another specific embodiment, the reference antibody is huAb9 A21 having a heavy chain according to SEQ ID NO:312 or 313, and a light chain according to SEQ ID NO:321. In another specific embodiment, the reference antibody is huAb9 A2V having a heavy chain according to SEQ ID NO:312 or 313, and a light chain according to SEQ ID NO:322.

In some embodiments, a bispecific binding protein of the disclosure comprises an immunomodulatory protein binding region comprising a $V_H$ sequence selected from the following sequences (CDR sequences in bold):

| $V_H$ | Sequence (N→C) | Identifier |
|---|---|---|
| muAb1 $V_H$ | QVQLQQPGAELVKPGASVKMSCKASGYTFTSYWITWVKQRPG QGLEWIGEINPGSGSTNYNEKFKSKATLTVDTSSSTAYMQLSSL TSEDSAVYYCARNRGTGDYWGQGTTLTVSS | (SEQ ID NO: 1) |
| muAb2 $V_H$ | QVQLQQSGAELMKPGASAKLSCKATGYTFTGYWIQWVKQRPG HGLEWIGEILPGGDHTKYNEKFRGKATFTSDTSSNTVYMQLSS LTTEDSAIYYCARVGGDYWGQGTTLTVSS | (SEQ ID NO: 2) |
| muAb3 $V_H$ | EVQLQQSGPELVKPGASVKISCKASGYTFTDYYMNWVKQSHGK SLEWIGDINPNNGGTSYNQKFKGKATLTVDKSSSTAYMELRSLT SEDSAVYYCARRGGLGRGTYALDYWGQGTSVTVSS | (SEQ ID NO: 3) |
| muAb4 $V_H$ | LVQPGGSLSLSCAASGFTFSDYYMSWVRQPPGKALEWLGFIRN KANGYTTEFSASVKGRFTISRDNSQSILYLQMNALRAEDSATYY CARYGGLRQGWYFDVWGTGTTVTVSS | (SEQ ID NO: 4) |
| muAb5 $V_H$ | DVQLQESGPGLVEPSQSLFLTCSVTGYSITTNYNWNWIRQFPGN KLEWMGYIRHDGTNNYNPSLKNRISIIRDTPKNQFFIKLNSVTTE DTAIYFCTRLDYWGQGTSVTVSS | (SEQ ID NO: 5) |
| muAb6 $V_H$ | QVQLQQPGAELVRPGSSVKLSCKASGYTFTSYWMHWVKQRPIQ GLEWIGNIDPSNGETHYNQKFKDKATLTVDKSSSTAYMQLSSLT SEDSAVYYCARERIYYSGSTYDGYFDVWGTGTTVTVSS | (SEQ ID NO: 6) |
| muAb8 $V_H$ | QVQLQQSGPELVKSGASVKISCKASGYTFTDYYINWVKQRPGQ GLEWIGWIFPGSGSVYCNEQFKGQATLTVDRSSSTAYMLLSSLT SEDSAVYFCASSLGKFAYWGQGTLVTVSA | (SEQ ID NO: 7) |
| muAb9 $V_H$ | DVQLQESGPGLVKPSQSLSLTCSVTGYSITSNYYWNWIRQFPGN KLEWMGYIRYDGSNNYNPSLKNRISITRDTSKNQFFLKLNSVTT EDTATYYCARLDYWGQGTTLTVSS | (SEQ ID NO: 8) |
| muAb10 $V_H$ | DVQLQESGPGLVKPSQSLSLTCSVTGYSITSNYYWNWIRQFPGN KLEWMGYIRYDGSNNYNPSLKNRISITRDTSKNQFFLRLNSVTTE DTATYYCTRLDYWGQGTTLTVSS | (SEQ ID NO: 9) |
| huAb6-1 $V_H$ | EVQLVQSGAEVKKPGSSVKVSCKASGYTFTSYWMHWVRQAPG QGLEWIGNIDPSNGETHYNQKFKDRATLTVDKSTSTAYMELSSL RSEDTAVYYCARERIYYSGSTYDGYFDVWGQGTTVTVSS | (SEQ ID NO: 10) |
| huAb6-2 $V_H$ | EVQLVQSGAEVKKPGSSVKVSCKASGYTFTSYWMHWVRQAPG QGLEWIGNIDPSNGETHYNQKFKDRVTITVDKSTSTAYMELSSL RSEDTAVYYCARERIYYSGSTYDGYFDVWGQGTTVTVSS | (SEQ ID NO: 11) |
| huAb6-3 $V_H$ | EVQLVQSGAEVKKPGSSVKVSCKASGYTFTSYWMHWVRQAPG QGLEWIGNIDPSNGETHYAQKFQGRVTITVDKSTSTAYMELSSL RSEDTAVYYCARERIYYSGSTYDGYFDVWGQGTTVTVSS | (SEQ ID NO: 12) |
| huAb8-1 $V_H$ | EVQLVQSGAEVKKPGSSVKVSCKASGYTFTDYYINWVRQAPGQ GLEWIGWIFPGSGSVYCNEQFKGRATLTVDRSTSTAYMELSSLR SEDTAVYFCASSLGKFAYWGQGTLVTVSS | (SEQ ID NO: 13) |
| huAb8-2 $V_H$ | EVQLVQSGAEVKKPGSSVKVSCKASGYTFTDYYINWVRQAPGQ GLEWIGWIFPGSGSVYSNEQFKGRATLTVDRSTSTAYMELSSLR SEDTAVYFCASSLGKFAYWGQGTLVTVSS | (SEQ ID NO: 14) |
| huAb8-3 $V_H$ | EVQLVQSGAEVKKPGSSVKVSCKASGYTFTDYYINWVRQAPGQ GLEWIGWIFPGSGSVYCNEQFKGRVTITVDKSTSTAYMELSSLR SEDTAVYYCASSLGKFAYWGQGTLVTVSS | (SEQ ID NO: 15) |
| huAb9-1 $V_H$ | EVQLQESGPGLVKPSETLSLTCTVSGYSITSNYYWNWIRQPPGKG LEWMGYIRYDGSNNYNPSLKNRITISRDTSKNQFSLKLSSVTAA DTAVYYCARLDYWGQGTTVTVSS | (SEQ ID NO: 16) |
| huAb9-2 $V_H$ | EVQLQESGPGLVKPSETLSLTCTVSGYSITSNYYWNWIRQPPGKG LEWMGYIRYDGSNNYNPSLKNRVTISRDTSKNQFSLKLSSVTAA DTAVYYCARLDYWGQGTTVTVSS | (SEQ ID NO: 17) |

| V$_H$ | Sequence (N→C) | Identifier |
|---|---|---|
| huAb9-3 V$_H$ | EVQLQESGPGLVKPSETLSLTCTVSGYSISSNYYWNWIRQPPGKG LEWMGYIRYDGSNNYNPSLKSRVTISRDTSKNQFSLKLSSVTAA DTAVYYCARLDYWGQGTTVTVSS | (SEQ ID NO: 18) |
| huAb9 Stab1 V$_H$ | EVQLVESGGGLVKPGETLSLTCTVSGYSITSNYYWNWIRQPPGK GLEWMGYIRYDGSNNYNPSLKGRVTISRDTSKNQFYLKLSSVTA ADTAVYYCARLDYWGQGTTVTVSS | (SEQ ID NO: 19) |
| huAb9 Stab2 V$_H$ | EVQLVESGGGLVQPGGSLRLSCAASGYSITSNYYWNWIRQPPGK GLEWMGYIRYDGSNNYNPSLKGRVTISRDTSKNQLYLKLSSVT AADTAVYYCARLDYWGQGTLVTVSS | (SEQ ID NO: 20) |
| huAb9 Stab3 V$_H$ | EVQLVESGGGLVKPGETLILTCTVSGYDITSNYYWNWIRQPPGK GLEWMGYIRYDGSNNYNPSLKGRVTISRDTSKNQFYLKLSSVTA ADTAVYYCARLDYWGQGTTVTVSS | (SEQ ID NO: 21) |
| huAb9 rehuVH4 V$_H$ | QVQLQESGPGLVKPSETLSLTCTVSGYSITSNYYWNWIRQPPGK GLEWMGYIRYDGSNNYNPSLKNRITISRDTSKNQFSLKLSSVTA ADTAVYYCARLDYWGQGTLVTVSS | (SEQ ID NO: 22) |
| huAb9 rehuVH3 V$_H$ | EVQLVESGGGLVQPGGSLRLSCAASGYSITSNYYWNWVRQAPG KGLEWMGYIRYDGSNNYNPSLKNRITISRDTSKNTFYLQMNSLR AEDTAVYYCARLDYWGQGTLVTVSS | (SEQ ID NO: 23) | and the amino acid sequence of the corresponding V$_L$ sequence is selected from the following sequences (CDR sequences in bold):

| V$_L$ | Sequence (N→C) | Identifier |
|---|---|---|
| muAb1 V$_L$ | DVVMTQTPLSLPVSLGDQASISCRSSQSLVHSYGNTYLHWYLQ KPGQSPKFLIYKVSNRISGVPDRLSGSGSGTDFTLKISRVEPEDLG VYFCSQSTHVPYTFGGGTKLEIK | (SEQ ID NO: 31) |
| muAb2 V$_L$ | DVVMTQTPLSLPVSLGDQASISCRSSQSLVNSNENTYLHWYLQK PGQSPKLLIYKVFNRYSGVPDRFSGSGSGTDFTLKISRVEAEDLG VYFCFQSTHVPWTFGGGTKLEIK | (SEQ ID NO: 32) |
| muAb3 V$_L$ | DIQMTQTTSSLSASLGDRVTISCRASQDISNYLNWYQQKPDGTV KPLIYYTSRLHLGVPSRFSGSGSGTDYSLTISNLEQEDIATYFCQQ GNTLPLTFGAGTKLELK | (SEQ ID NO: 33) |
| muAb4 V$_L$ | DIQMTQTTSSLSASLGDRVTISCRASQDIRNYLNWYQQKPDGTV KLLIYYTSRLHSGVPSRFSGSGSGTDYSLTISNLEQEDIATYFCQQ GKTLPWTFGGGSKLEMK | (SEQ ID NO: 34) |
| muAb5 V$_L$ | DAVMTQTPLSLPVSLGDQASISCRSSQSLENSYGNTFLNWFLQR PGQSPQLLIYRVSNRFCGVPDRFSGSGSGTDFTLKISRVEAEDLGI YFCLQVTHVPYTFGGGTKLEIK | (SEQ ID NO: 35) |
| muAb6 V$_L$ | QIVLTQSPAIMSASPGEKVTMTCSASSSLSYMHWYQQKSGTSPK RWIYDTSKLASGVPARFSGSGSGTSYSLTISSMEAEDAATYYCQ QWSSNPWTFGGGTKLEIK | (SEQ ID NO: 36) |
| muAb7 V$_L$ | QIVLTQSPAIMSASPGEKVTMTCSASSSLSYMHWYQQKSGTSPK RWIYDTSKLASGVPARFSGSGSGTSYSLTISSMEGEDGATYYCQ QWSSNPWTFGGGTKLEIK | (SEQ ID NO: 37) |
| muAb8 V$_L$ | DIVMTQSQKFMSTTVGDRVSITCKASQSVVTAVAWYQQKPGQS PKLLIYSASNRYTGVPDRFTGSGSGTDFALTIRTMQSEDLADYFC QQYSSYPYTFGGGTKLEIK | (SEQ ID NO: 38) |
| muAb9 V$_L$ | DAVMTQTPLSLPVSLGDQASISCRSSQSLENTNGNTFLNWFLQK PGQSPQLLIYRVSNRFSGVPDRFSGSGSGTDFTLKISRVEAEDLGV YFCLQVTHVPFTFGSGTKLEIK | (SEQ ID NO: 39) |
| muAb10 V$_L$ | DAVMTQTPLSLPVSLGDQASISCRSSQSLENSNGNTFLNWFLQK PGQSPQLLIYRISNRFSGVPDRFSGSGSGTDFTLKISRVEAEDLGV YFCLQVTHVPFTFGSGTKLEIK | (SEQ ID NO: 40) |
| huAb6-1 V$_L$ | DIQLTQSPSFLSASVGDRVTITCSASSSLSYMHWYQQKPGKSPKR WIYDTSKLASGVPSRFSGSGSGTEYTLTISSLQPEDFATYYCQQW SSNPWTFGGGTKVEIK | (SEQ ID NO: 41) |

| $V_L$ | Sequence (N→C) | Identifier |
|---|---|---|
| huAb8-1 $V_L$ | DIQMTQSPSSLSASVGDRVTITCKASQSVVTAVAWYQQKPGKSP KLLIYSASNRYTGVPSRFSGSGSGTDFTLTISSLQPEDFATYFCQQ YSSYPYTFGGGTKVEIK | (SEQ ID NO: 42) |
| huAb9-1 $V_L$ | DAVMTQTPLSLSVTPGQPASISCRSSQSLENTNGNTFLNWFLQK PGQSPQLLIYRVSNRFSGVPDRFSGSGSGTDFTLKISRVEAEDVG VYFCLQVTHVPFTFGQGTKLEIK | (SEQ ID NO: 43) |
| huAb9-4 $V_L$ | DAVMTQTPLSLSVTPGQPASISCRSSQSLENTNGNTFLNWYLQK PGQSPQLLIYRVSNRFSGVPDRFSGSGSGTDFTLKISRVEAEDVG VYYCLQVTHVPFTFGQGTKLEIK | (SEQ ID NO: 44) |
| huAb9 Stab1 $V_L$ | DAVMTQTPLSLSVTEGQPASISCRSSQSLENTNGNTFLNWYLQK PGQSPQLLIYRVSNRFSGVPDRFSGSGSGTDFTLKISRVEAEDVG VYYCLQVTHVPFTFGQGTKLEIK | (SEQ ID NO: 45) |
| huAb9 Stab3 $V_L$ | DAVMTQTPLSLAVLPGQPASISCRSSQSLENTNGNTFLNWYLQK PGQSPQLLIYRVSNRFSGVPDRFSGSGSGTDFTLKISRVEAEDVG VYYCLQVTHVPFTFGQGTKLEIK | (SEQ ID NO: 46) |
| huAb9 Stab VK1 $V_L$ | DIQMTQSPSSLSASVGDRVTITCRSSQSLENTNGNTFLNWVQQK PGKAPKLLIYRVSNRFSGVPSRFSGSGSGTDFTLTISSLQPEDFAT YYCLQVTHVPFTFGQGTKVEIK | (SEQ ID NO: 47) |
| huAb9 rehu VK2 $V_L$ | DAVMTQSPLSLPVTLGEPASISCRSSQSLENTNGNTFLNWFQQK PGQSPRLLIYRVSNRFSGVPDRFSGSGSGTDFTLKISRVEAEDVGV YYCLQVTHVPFTFGQGTKLEIK | (SEQ ID NO: 48) |
| huAb9 rehu VK1 $V_L$ | DAQMTQSPSSLSASVGDRVTITCRSSQSLENTNGNTFLNWFQQK PGKAPKLLIYRVSNRFSGVPSRFSGSGSGTDFTLTISSLQPEDFAT YYCLQVTHVPFTFGQGTKLEIK | (SEQ ID NO: 49) |
| huAb9 A2I $V_L$ | DIVMTQTPLSLSVTPGQPASISCRSSQSLENTNGNTFLNWYLQKP GQSPQLLIYRVSNRFSGVPDRFSGSGSGTDFTLKISRVEAEDVG VYYCLQVTHVPFTFGQGTKLEIK | (SEQ ID NO: 50) |
| huAb9 A2V $V_L$ | DVVMTQTPLSLSVTPGQPASISCRSSQSLENTNGNTFLNWYLQK PGQSPQLLIYRVSNRFSGVPDRFSGSGSGTDFTLKISRVEAEDVG VYYCLQVTHVPFTFGQGTKLEIK | (SEQ ID NO: 51) |

In some embodiments, a bispecific binding protein of the disclosure, e.g., a protein of formula (I), is suitable for administration to humans. In a specific embodiment, the bispecific binding protein comprises humanized immunomodulatory protein binding domains. In another specific embodiment, the bispecific binding protein comprises an immunomodulatory protein binding region comprising a $V_H$ sequence selected from the following sequences (CDR sequences in bold):

| $V_L$ | Sequence (N→C) | Identifier |
|---|---|---|
| huAb6-1 $V_H$ | EVQLVQSGAEVKKPGSSVKVSCKASGYTFTSYWMHWVRQAP GQGLEWIGNIDPSNGETHYNQKFKDRATLTVDKSTSTAYMELS SLRSEDTAVYYCARERIYYSGSTYDGYFDVWGQGTTVTSS | (SEQ ID NO: 10) |
| huAb6-2 $V_H$ | EVQLVQSGAEVKKPGSSVKVSCKASGYTFTSYWMHWVRQAP GQGLEWIGNIDPSNGETHYNQKFKDRVTITVDKSTSTAYMELS SLRSEDTAVYYCARERIYYSGSTYDGYFDVWGQGTTVTSS | (SEQ ID NO: 11) |
| huAb6-3 $V_H$ | EVQLVQSGAEVKKPGSSVKVSCKASGYTFTSYWMHWVRQAP GQGLEWIGNIDPSNGETHYAQKFQGRVTITVDKSTSTAYMELS SLRSEDTAVYYCARERIYYSGSTYDGYFDVWGQGTTVTSS | (SEQ ID NO: 12) |
| huAb8-1 $V_H$ | EVQLVQSGAEVKKPGSSVKVSCKASGYTFTDYYINWVRQAPG QGLEWIGWIFPGSGSVYCNEQFKGRATLTVDRSTSTAYMELSS LRSEDTAVYFCASSLGKFAYWGQGTLVTVSS | (SEQ ID NO: 13) |
| huAb8-2 $V_H$ | EVQLVQSGAEVKKPGSSVKVSCKASGYTFTDYYINWVRQAPG QGLEWIGWIFPGSGSVYSNEQFKGRATLTVDRSTSTAYMELSS LRSEDTAVYFCASSLGKFAYWGQGTLVTVSS | (SEQ ID NO: 14) |
| huAb8-3 $V_H$ | EVQLVQSGAEVKKPGSSVKVSCKASGYTFTDYYINWVRQAPG QGLEWIGWIFPGSGSVYCNEQFKGRVTITVDKSTSTAYMELSS LRSEDTAVYYCASSLGKFAYWGQGTLVTVSS | (SEQ ID NO: 15) |

| $V_L$ | Sequence (N→C) | Identifier |
|---|---|---|
| huAb9-1 $V_H$ | EVQLQESGPGLVKPSETLSLTCTVSGYSITSNYYWNWIRQPPK GLEWMGYIRYDGSNNYNPSLKNRITISRDTSKNQFSLKLSSVTA ADTAVYYCARLDYWGQGTTVTVSS | (SEQ ID NO: 16) |
| huAb9-2 $V_H$ | EVQLQESGPGLVKPSETLSLTCTVSGYSITSNYYWNWIRQPPK GLEWMGYIRYDGSNNYNPSLKNRVTISRDTSKNQFSLKLSSVT AADTAVYYCARLDYWGQGTTVTVSS | (SEQ ID NO: 17) |
| huAb9-3 $V_H$ | EVQLQESGPGLVKPSETLSLTCTVSGYSISSNYYWNWIRQPPK GLEWMGYIRYDGSNNYNPSLKSRVTISRDTSKNQFSLKLSSVT AADTAVYYCARLDYWGQGTTVTVSS | (SEQ ID NO: 18) |
| huAb9 Stab1 $V_H$ | EVQLVESGGGLVKPGETLSLTCTVSGYSITSNYYWNWIRQPPG KGLEWMGYIRYDGSNNYNPSLKGRVTISRDTSKNQFYLKLSSV TAADTAVYYCARLDYWGQGTTVTVSS | (SEQ ID NO: 19) |
| huAb9 Stab2 $V_H$ | EVQLVESGGGLVQPGGSLRLSCAASGYSITSNYYWNWIRQPPG KGLEWMGYIRYDGSNNYNPSLKGRVTISRDTSKNQLYLKLSSV TAADTAVYYCARLDYWGQGTLVTVSS | (SEQ ID NO: 20) |
| huAb9 Stab3 $V_H$ | EVQLVESGGGLVKPGETLILTCTVSGYDITSNYYWNWIRQPPK GLEWMGYIRYDGSNNYNPSLKGRVTISRDTSKNQFYLKLSSVT AADTAVYYCARLDYWGQGTTVTVSS | (SEQ ID NO: 21) |
| huAb9 rehuVH4 $V_H$ | QVQLQESGPGLVKPSETLSLTCTVSGYSITSNYYWNWIRQPPK GLEWMGYIRYDGSNNYNPSLKNRITISRDTSKNQFSLKLSSVTA ADTAVYYCARLDYWGQGTLVTVSS | (SEQ ID NO: 22) |
| huAb9 rehuVH3 $V_H$ | EVQLVESGGGLVQPGGSLRLSCAASGYSITSNYYWNWVRQAP GKGLEWMGYIRYDGSNNYNPSLKNRITISRDTSKNTFYLQMNS LRAEDTAVYYCARLDYWGQGTLVTVSS | (SEQ ID NO: 23) | and the amino acid sequence of the corresponding $V_L$ is selected from the following sequences (CDR sequences in bold):

| $V_L$ | Sequence (N→C) | Identifier |
|---|---|---|
| huAb6-1 $V_L$ | DIQLTQSPSFLSASVGDRVTITCSASSSLSYMHWYQQKPGKSPK RWIYDTSKLASGVPSRFSGSGSGTEYTLTISSLQPEDFATYYCQQ WSSNPWTFGGGTKVEIK | (SEQ ID NO: 41) |
| huAb8-1 $V_L$ | DIQMTQSPSSLSASVGDRVTITCKASQSVVTAVAWYQQKPGKS PKLLIYSASNRYTGVPSRFSGSGSGTDFTLTISSLQPEDFATYFCQ QYSSYPYTFGGGTKVEIK | (SEQ ID NO: 42) |
| huAb9-1 $V_L$ | DAVMTQTPLSLSVTPGQPASISCRSSQSLENTNGNTFLNWFLQK PGQSPQLLIYRVSNRFSGVPDRFSGSGSGTDFTLKISRVEAEDVG VYFCLQVTHVPFTFGQGTKLEIK | (SEQ ID NO: 43) |
| huAb9-4 $V_L$ | DAVMTQTPLSLSVTPGQPASISCRSSQSLENTNGNTFLNWYLQ KPGQSPQLLIYRVSNRFSGVPDRFSGSGSGTDFTLKISRVEAEDV GVYYCLQVTHVPFTFGQGTKLEIK | (SEQ ID NO: 44) |
| huAb9 Stab1 $V_L$ | DAVMTQTPLSLSVTEGQPASISCRSSQSLENTNGNTFLNWYLQ KPGQSPQLLIYRVSNRFSGVPDRFSGSGSGTDFTLKISRVEAEDV GVYYCLQVTHVPFTFGQGTKLEIK | (SEQ ID NO: 45) |
| huAb9 Stab3 $V_L$ | DAVMTQTPLSLAVLPGQPASISCRSSQSLENTNGNTFLNWYLQ KPGQSPQLLIYRVSNRFSGVPDRFSGSGSGTDFTLKISRVEAEDV GVYYCLQVTHVPFTFGQGTKLEIK | (SEQ ID NO: 46) |
| huAb9 Stab VK1 $V_L$ | DIQMTQSPSSLSASVGDRVTITCRSSQSLENTNGNTFLNWYQQ KPGKAPKWYRVSNRFSGVPSRFSGSGSGTDFTLTISSLQPEDFA TYYCLQVTHVPFTFGQGTKVEIK | (SEQ ID NO: 47) |
| huAb9 rehu VK2 $V_L$ | DAVMTQSPLSLPVTLGEPASISCRSSQSLENTNGNTFLNWFQQK PGQSPRLLIYRVSNRFSGVPDRFSGSGSGTDFTLKISRVEAEDVG VYYCLQVTHVPFTFGQGTKLEIK | (SEQ ID NO: 48) |
| huAb9 rehu VK1 $V_L$ | DAQMTQSPSSLSASVGDRVTITCRSSQSLENTNGNTFLNWFQQ KPGKAPKLLIYRVSNRFSGVPSRFSGSGSGTDFTLTISSLQPEDFA TYYCLQVTHVPFTFGQGTKLEIK | (SEQ ID NO: 49) |

-continued

| V_L | Sequence (N→C) | Identifier |
|---|---|---|
| huAb9 A2I V_L | DIVMTQTPLSLSVTPGQPASISCRSSQSLENTNGNTFLNWYLQK PGQSPQLLIYRVSNRFSGVPDRFSGSGSGTDFTLKISRVEAEDVG VYYCLQVTHVPFTFGQGTKLEIK | (SEQ ID NO: 50) |
| huAb9 A2V V_L | DVVMTQTPLSLSVTPGQPASISCRSSQSLENTNGNTFLNWYLQ KPGQSPQLLIYRVSNRFSGVPDRFSGSGSGTDFTLKISRVEAEDV GVYYCLQVTHVPFTFGQGTKLEIK | (SEQ ID NO: 51) |

In some embodiments, the bispecific binding protein has a CD40 binding domain with amino acid sequences of the CDRs of:

| CDR | Sequence (N→C) | Identifier |
|---|---|---|
| V_H CDR#1 | GYSITSNYYWN | (SEQ ID NO: 25) |
| V_H CDR#2 | YIRYDGSNNYNPSLKN | (SEQ ID NO: 26) |
| V_H CDR#3 | LDY | (SEQ ID NO: 27) |
| V_L CDR#1 | RSSQSLENTNGNTFLN | (SEQ ID NO: 55) |
| V_L CDR#2 | RVSNRFS | (SEQ ID NO: 56) |
| V_L CDR#3 | LQVTHVPFT | (SEQ ID NO: 57) |

In some embodiments, the bispecific binding protein has a CD40 binding domain comprising a $V_H$ according to SEQ ID NO:10 and a $V_L$ according to SEQ ID NO:41. In some embodiments, the bispecific binding protein has a CD40 binding domain comprising a $V_H$ according to SEQ ID NO:11 and a $V_L$ according to SEQ ID NO:41. In some embodiments, the bispecific binding protein has a CD40 binding domain comprising a $V_H$ according to SEQ ID NO:12 and a $V_L$ according to SEQ ID NO:41. In some embodiments, the bispecific binding protein has a CD40 binding domain comprising a $V_H$ according to SEQ ID NO:13 and a $V_L$ according to SEQ ID NO:42. In some embodiments, the bispecific binding protein has a CD40 binding domain comprising a $V_H$ according to SEQ ID NO:14 and a $V_L$ according to SEQ ID NO:42. In some embodiments, the bispecific binding protein has a CD40 binding domain comprising a $V_H$ according to SEQ ID NO:15 and a $V_L$ according to SEQ ID NO:42. In some embodiments, the bispecific binding protein has a CD40 binding domain comprising a $V_H$ according to SEQ ID NO:16 and a $V_L$ according to SEQ ID NO:43. In some embodiments, the bispecific binding protein has a CD40 binding domain comprising a $V_H$ according to SEQ ID NO:17 and a $V_L$ according to SEQ ID NO:43. In some embodiments, the bispecific binding protein has a CD40 binding domain comprising a $V_H$ according to SEQ ID NO:18 and a $V_L$ according to SEQ ID NO:43. In some embodiments, the bispecific binding protein has a CD40 binding domain comprising a $V_H$ according to SEQ ID NO:16 and a $V_L$ according to SEQ ID NO:44. In some embodiments, the bispecific binding protein has a CD40 binding domain comprising a $V_H$ according to SEQ ID NO:17 and a $V_L$ according to SEQ ID NO:44. In some embodiments, the bispecific binding protein has a CD40 binding domain comprising a $V_H$ according to SEQ ID NO:17 and a $V_L$ according to SEQ ID NO:49. In some embodiments, the bispecific binding protein has a CD40 binding domain comprising a $V_H$ according to SEQ ID NO:17 and a $V_L$ according to SEQ ID NO:50. In some embodiments, the bispecific binding protein has a CD40 binding domain comprising a $V_H$ according to SEQ ID NO:17 and a $V_L$ according to SEQ ID NO:51. In some embodiments, the bispecific binding protein has a CD40 binding domain comprising a $V_H$ according to SEQ ID NO:18 and a $V_L$ according to SEQ ID NO:44. In some embodiments, the bispecific binding protein has a CD40 binding domain comprising a $V_H$ according to SEQ ID NO:22 and a $V_L$ according to SEQ ID NO:48. In some embodiments, the bispecific binding protein has a CD40 binding domain comprising a $V_H$ according to SEQ ID NO:22 and a $V_L$ according to SEQ ID NO:49. In some embodiments, the bispecific binding protein has a CD40 binding domain comprising a $V_H$ according to SEQ ID NO:23 and a $V_L$ according to SEQ ID NO:48. In some embodiments, the bispecific binding protein has a CD40 binding domain comprising a $V_H$ according to SEQ ID NO:23 and a $V_L$ according to SEQ ID NO:49.

In some embodiments, the bispecific binding proteins compete for binding human 4-1BB (SEQ ID NO:273) on cells expressing 4-1BB in in vitro assays with a reference antibody. The reference antibody may be any of the anti-4-1BB antibodies described herein or known in the art. In specific embodiments, the reference antibody is selected from antibody TABBY101 ("TABBY101"), antibody TABBY102 ("TABBY102"), antibody TABBY103 ("TABBY103"), antibody TABBY104 ("TABBY104"), antibody TABBY105 ("TABBY105"), antibody TABBY106 ("TABBY106"), antibody TABBY107 ("TABBY107"), antibody TABBY108 ("TABBY108"), antibody TABBY1.1 ("TABBY1.1"), antibody TABBY3 ("TABBY3"), antibody TABBY5 ("TABBY5"), antibody TABBY6 ("TABBY6"), antibody TABBY9 ("TABBY9"), and antibody TABBY10 ("TABBY10"). In one embodiment, the reference antibody is TABBY106. In another embodiment, the reference antibody is TABBY107. In some embodiments, the reference antibody is a humanized version of TABBY106, TABBY107, or TABBY108. In a specific embodiment, the reference antibody is hu106-1-hIgG_1 having a heavy chain according to SEQ ID NO:330 or 331, and a light chain according to SEQ ID NO:334. In another specific embodiment, the reference antibody is hu107-1-hIgG_1 having a heavy chain according to SEQ ID NO:332 or 333, and a light chain according to SEQ ID NO:335.

In some embodiments, a bispecific binding protein of the disclosure comprises an immunomodulatory binding region comprising a $V_H$ sequence selected from the following sequences (CDR sequences in bold):

| $V_H$ | Sequence (N→C) | Identifier |
|---|---|---|
| TABBY101 $V_H$ | QIQLVQSGPELKKPGESVKISCKASGYTFTDFAIHWVKQAPGKG LKWMGWINTYTGKPTYADDFKGRFVFSLEASASTANLQISNLK NEDTATYFCSRGAPRPTNWGQGTLVTVSS | (SEQ ID NO: 61) |
| TABBY102 $V_H$ | QVQLQQSGAELAKPGSSVKISCKASGYTLTSYYLNWIKQTTGQG LEYIGYIDTGSGGSHYNEKFKGKATLTVDKSSSTAFMQLSSLTP VDSAVYYCARGGYYDGFFDYWGQGVMVTVSS | (SEQ ID NO: 62) |
| TABBY103 $V_H$ | QVQLQQSGAELVKPGSSVKISCKASDYTFTSNFLHWIKQQPGNG LEWIGWINPGDGDTYYNQKFNGKATLTADKSSTTAYMQLSSLT SEDSAVYFCAGGNYYAAHYPPGPWYFDFWGPGTMVTVSS | (SEQ ID NO: 63) |
| TABBY104 $V_H$ | QVTLKESGPGILQPSQTLSLTCTFSGFSLSTDGLGVTWIRQPSGK GLEWLANIWWDDDKDYNPSLKNRLTISKDTSNPQAFLKITNVD TADTATYYCARIVPNSGHEDYWGQGVMVIVSS | (SEQ ID NO: 64) |
| TABBY105 $V_H$ | EVQLVESGGGLVQPGRSMKLSCAASGFTFNNYDMAWVCQAPK RGLEWVATISYDGSTTYYRDSVKGRFTFSRDNAKSTLYLQMDS LRSEDTATYYCARVGAGDFDYWGQGVMVTVSS | (SEQ ID NO: 65) |
| TABBY106 $V_H$ | QVQLQQSGAELAKPGTSVKLSCKASGYTFTSYYIYWVKQRPGQ GLEWIGNIWPGNGGTFYGEKFMGKATFTADTSSSTAYMLLGSL TPEDSAYYFCARRPDYSGDDYFDYWGQGVLVTVSS | (SEQ ID NO: 66) |
| TABBY107 $V_H$ | QVKLVQSGAALVKPGASVKMSCKASDYTFNDYWVSWVKQRH GESLEWIGEIYPNSGATNFNGKFRGKATLTVDNPTSTAYMELSR LTSEDSAIYYCTREYTRDWFAYWGQGTLVTVSS | (SEQ ID NO: 67) |
| TABBY108 $V_H$ | EIQLQESGPGLVRPSQSLSLACSVTGYTITSAYDWSWIRKFPGNK MEWMGYIAYIGFTNSNPSLKSRISITRDTSKNQFFLQLKSVTTED TATYYCARWSSYIPRYFDFWGPGTMVTVSS | (SEQ ID NO: 68) | and the amino acid sequence of the corresponding $V_L$ sequence is selected from the following sequences (CDR sequences in bold):

| $V_L$ | Sequence (N→C) | Identifier |
|---|---|---|
| TABBY101 $V_L$ | DIQMTQSPASLSASLGETVSIECLASEDIYNNLAWYQQKPGKSPQ LLIYYESRLQDGVPTRFSGSGSGTQYSLKINSLESEDAATYFCLQ DSEYPYTFGAGTKLELK | (SEQ ID NO: 81) |
| TABBY102 $V_L$ | DIQMTQSPASLSASLGETVSIECLASEGISNDLAWYQQKSGKSPQ FLIYAASRLQDGVPSRFSGSGSGTRYSLKISGMQPEDEADYFCQQ SYKYPPTFGSGTKLEIK | (SEQ ID NO: 82) |
| TABBY103 $V_L$ | DTVLTQSPALAVSLGQRVTISCRASKSVSIYMHWYQQKSGQQPK FLIYTASNLESGVPSRFSGSGSGTDFTLTIDPVEADDIANYYCQQS NELPFTFGSGTKLEIK | (SEQ ID NO: 83) |
| TABBY104 $V_L$ | DIQMTQSPSFLSASVGDRVTINCKASQNINRYLNWYQQKLGEAP KLLMYNTNSMQTGIPSRFSGSGSGTDFTLTISSLQPEDVATYFCL QHNSWPRTFGGGTKLELK | (SEQ ID NO: 84) |
| TABBY105 $V_L$ | DIRMTQSPVSLSTSLGETVNIECLASEDIYSDLAWYQQKPGKSPQ LLIYSTNTLQNGVPSRFSGSGSGTQYSLKINSLQSEDVATYFCQQ NNNYPYTFGAGTKLELK | (SEQ ID NO: 85) |
| TABBY106 $V_L$ | QVVLTQPKSVSTSLKSTVKLSCKLNSGNIGSYYVHWYQQHAGR SPTTMIYRDDKRPDGVPDRFSGSIDSSSNSAFLTINNVQTEDDAIY FCHSYDSTITPVFGGGTKLTVL | (SEQ ID NO: 86) |
| TABBY107 $V_L$ | DVVLTQTPSILSATIGQSVSISCRSSQSLLDSDGNTYLYWFLQRPG QSPQRLIYLVSNLGSGVPNRFSGSGSGTDFTLKISGVEAEDLGIYY CMQPTHAPYTFGAGTKLELK | (SEQ ID NO: 87) |
| TABBY108 $V_L$ | QAVLTQPNSVSTSLGSTVKLSCTITSGNIEDNFVHWYQHYEGRS PTTMIHNDDKRPDGVPDRFSGSIDSSSNSAFLTINNVEIEDEAIYFC HSYVSSINIFGGGTKLTVL | (SEQ ID NO: 88) |

In some embodiments, the bispecific binding protein has a 4-1BB binding domain comprising a $V_H$ according to SEQ ID NO:61 and a $V_L$ according to SEQ ID NO:81. In some embodiments, the bispecific binding protein has a 4-1BB binding domain comprising a $V_H$ according to SEQ ID NO:62 and a $V_L$ according to SEQ ID NO:82. In some embodiments, the bispecific binding protein has a 4-1BB binding domain comprising a $V_H$ according to SEQ ID NO:63 and a $V_L$ according to SEQ ID NO:83. In some embodiments, the bispecific binding protein has a 4-1BB binding domain comprising a $V_H$ according to SEQ ID NO:64 and a $V_L$ according to SEQ ID NO:84. In some embodiments, the bispecific binding protein has a 4-1BB binding domain comprising a $V_H$ according to SEQ ID NO:65 and a $V_L$ according to SEQ ID NO:85. In some embodiments, the bispecific binding protein has a 4-1BB binding domain comprising a $V_H$ according to SEQ ID NO:66 and a $V_L$ according to SEQ ID NO:86. In some embodiments, the bispecific binding protein has a 4-1BB binding domain comprising a $V_H$ according to SEQ ID NO:67 and a $V_L$ according to SEQ ID NO:87. In some embodiments, the bispecific binding protein has a 4-1BB binding domain comprising a $V_H$ according to SEQ ID NO:68 and a $V_L$ according to SEQ ID NO:88.

In some embodiments, a bispecific binding protein of the disclosure comprises an immunomodulatory binding region comprising a $V_H$ sequence selected from the following sequences (CDR sequences in bold):

| $V_H$ | Sequence (N→C) | Identifier |
|---|---|---|
| TABBY1.1 $V_H$ | EVQLVESGGDLVKPGGSQKLSCAASGFTFSSYGMSWVRQTPDRR LEWVAAIISGGSYTYYPDSVKGRFTISRDNAKNTLYLQMNSLKSE DTAMYYCARHGGYDGNYDYYAMDYWGQGTSVTVSS | (SEQ ID NO: 73) |
| TABBY3 $V_H$ | GVQLVESGGGLVQPGGSRKLSCAASGFTFSSFGMHWFRQAPEKG LEWVAYISSGSSTIYYADTLKGRFTISRDNPKNTLFLQMTSLRSED TAMYYCARDWVDYWGQGTTLTVSS | (SEQ ID NO: 74) |
| TABBY5 $V_H$ | EVQLQQSGAELVRPGASVKLSCTASGFNIKDYYMHWVKQRPEQ GLEWIGRIDPEDGDTEYVPKFQGKATMTADTSSNTAYLQLSSLT SEDTAVYYCTPYSNYVYWYFDVWGTGTTVTVSS | (SEQ ID NO: 75) |
| TABBY6 $V_H$ | EVQLQQSGAELVRPGASVKLSCTASGFNIKDYYMHWVKQRPEQ GLEWIGRIDPEDGDTEYAPKFQGKATMTADTSSNTAYLQLSTLT SEDTAVYYCTPYSNYVYWYFDVWGTGTTVTVSS | (SEQ ID NO: 76) |
| TABBY9 $V_H$ | QVQLKQSGPGLVQPSQSLSITCTVSGFSLTSYGVHWVRQSPGKGL EWLGMIWSGGSTDYNAAFISRLSISKDNSKSQVFFKMNSLQADD TALYFCASYGGFYETMDYWGQGTSVTVSS | (SEQ ID NO: 77) |
| TABBY10 $V_H$ | QIQLVQSGPELKKPGETVKISCKASGYTFTTYGMSWVKQAPGKG LKWMGWINTYSGVPTYADDFKGRFAFSLETSASTAYLQINNLKN EDTATYFCARGNDGNYYGWFAHWGQGTLVTVSA | (SEQ ID NO: 78) | and the amino acid sequence of the corresponding $V_L$ sequence is selected from the following sequences (CDR sequences in bold):

| $V_L$ | Sequence (N→C) | Identifier |
|---|---|---|
| TABBY1.1 $V_L$ | DVLMTQTPLSLPVSLGDQASISCRSSQSIVDSDGITYLEWYLQKP GQSPKLLIYKVSNRFSGVPDRFSGSGSGTDFTLRISRVEAEDLGLY YCFQVSHVPWTFGGGTKLEIK | (SEQ ID NO: 96) |
| TABBY3 $V_L$ | DIVITQDELSNPVTSGESASISCRSSKSLLYKDGKTYLNWFLQRP GQSPQLLIYLMSTRASGVSDRFTGSGSGTDFTLEISRVKAEDVGV YYCQQPVEYPYTFGGGTKLEIK | (SEQ ID NO: 97) |
| TABBY5 $V_L$ | DVVMTQTPLTLSVTIGQPASISCKSSQSLLDSDGKTYLNWLLQR PGQSPKRLIYLVSKLDSGVPDRFTGSGSGTDFTLKISRVEAEDLG VYYCWQGTHFPHTFGGGTKLEIK | (SEQ ID NO: 98) |
| TABBY6 $V_L$ | DVVMTQTPLTLSVTIGQAASISCKSSQSLLDSDGKTYLNWLLQR PGQSPKRLIYLVSKLDSGVPDRFTGSGSGTDFTLKISRVEAEDLG VYYCWQGTHFPHTFGGGTKLEIK | (SEQ ID NO: 99) |
| TABBY9 $V_L$ | DIQMTQTTSSLSASLGDRITISCRASQDISNYLNWYQRKPDGTVK LLIYYTSRLHSGVPSRFSGSGSGRDYSLTISNLEQEDIATYFCQQG NTLPYTFGGGTKLEIK | (SEQ ID NO: 100) |
| TABBY10 $V_L$ | DIQMTQSPSSLSASLGGKVTITCKASQDIHNYISWYQHKPGKGPR LVIHYTSTLQPGIPSRFSGSGSGRDYSFSISNLEPEDIATYYCLQY DNLYTFGGGTKLEIK | (SEQ ID NO: 101) |

In some embodiments, the bispecific binding protein has a 4-1BB binding domain comprising a $V_H$ according to SEQ ID NO:73 and a $V_L$ according to SEQ ID NO:96. In some embodiments, the bispecific binding protein has a 4-1BB binding domain comprising a $V_H$ according to SEQ ID NO:74 and a $V_L$ according to SEQ ID NO:97. In some embodiments, the bispecific binding protein has a 4-1BB binding domain comprising a $V_H$ according to SEQ ID NO:75 and a $V_L$ according to SEQ ID NO:98. In some embodiments, the bispecific binding protein has a 4-1BB binding domain comprising a $V_H$ according to SEQ ID NO:76 and a $V_L$ according to SEQ ID NO:99. In some embodiments, the bispecific binding protein has a 4-1BB binding domain comprising a $V_H$ according to SEQ ID NO:77 and a $V_L$ according to SEQ ID NO:100. In some embodiments, the bispecific binding protein has a 4-1BB binding domain comprising a $V_H$ according to SEQ ID NO:78 and a $V_L$ according to SEQ ID NO:101.

In some embodiments, a bispecific binding protein of the disclosure, e.g., a protein of formula (I), is suitable for administration to humans. In a specific embodiment, the bispecific binding protein comprises humanized immunomodulatory protein binding domains. In certain embodiments, a bispecific binding protein of the disclosure comprises an immunomodulatory binding region comprising a $V_H$ sequence selected from the following sequences (CDR sequences in bold):

| $V_H$ | Sequence (N→C) | Identifier |
|---|---|---|
| hu106.1x $V_H$ | EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSS | (SEQ ID NO: 69) |
| hu106.1y $V_H$ | EVQLVESGGGLVQPGGSLRLSCAASGYTFTSYYIYWVRQAPGKGLEWIGNIWPGNGGTFYGEKFMGRATFSADTSKNTAYLQMNSLRAEDTAVYYCARRPDYSGDDYFDYWGQGTLVTVSS | (SEQ ID NO: 70) |
| hu107.1x $V_H$ | EVQLVQSGAEVKKPGSSVKVSCKASDYTFNDYWVSWVRQAPGQGLEWIGEIYPNSGATNFNGKFRGRATLTVDNSASTAYMELSSLRSEDTAVYYCTREYTRDWFAYWGQGTLVTVSS | (SEQ ID NO: 71) |
| hu107.1y $V_H$ | EVQLVESGGGLVQPGGSLRLSCAASGYTFNDYWVSWVRQAPGKGLEWIGEIYPNSGATNFNGKFRGRATLSVDNSKNTAYLQMNSLRAEDTAVYYCTREYTRDWFAYWGQGTLVTVSS | (SEQ ID NO: 72) | and the amino acid sequence of the corresponding $V_L$ sequence is selected from the following sequences (CDR sequences in bold):

| $V_L$ | Sequence (N→C) | Identifier |
|---|---|---|
| hu106.1x $V_L$ | NVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVL | (SEQ ID NO: 89) |
| hu106.2x $V_L$ | QVVLTQPPSASGTPGQRVTISCKLNSGNIGSYYVHWYQQLPGTAPKTMIYRDDKRPDGVPDRFSGSSSSNSASLAISGLQSEDEADYYCHSYDSTITPVFGGGTKLTVL | (SEQ ID NO: 90) |
| hu106.3x $V_L$ | SVELTQPPSVSVSPGQTARITCKLNSGNIGSYYVHWYQQKPGQAPVTMIYRDDKRPDGIPERFSGSSDSSSNSAFLTISGVQAEDEADYYCHSYDSTITPVFGGGTKLTVL | (SEQ ID NO: 91) |
| hu106.4x $V_L$ | EVVLTQPPSLSASPGASARLTCKLNSGNIGSYYVHWYQQKPGSPPRTMIYRDDKRPDGVPSRFSGSKDSSSNSAFLLISGLQSEDEADYYCHSYDSTITPVFGGGTKLTVL | (SEQ ID NO: 92) |
| hu106.5x $V_L$ | DVQLTQSPSSLSASVGDRVTITCKLNSGNIGSYYVHWYQQKPGKAPKTMIYRDDKRPDGVPSRFSGSGDSSSNSAFLTISSLQPEDFATYYCHSYDSTITPVFGQGTKVEIK | (SEQ ID NO: 93) |
| hu107.1x $V_L$ | DVVLTQSPLSLPVTLGQPASISCRSSQSLLDSDGNTYLYWFQQRPGQSPRRLIYLVSNLGSGVPDRFSGSGSGTDFTLKISRVEAEDVGVYYCMQPTHAPYTFGQGTKLEIK | (SEQ ID NO: 94) |
| hu107.1y $V_L$ | DVQLTQSPSSLSASVGDRVTITCRSSQSLLDSDGNTYLYWFQQKPGKAPKRLIYLVSNLGSGVPSRFSGSGSGTDFTLTISSLQPEDFATYYCMQPTHAPYTFGQGTKVEIK | (SEQ ID NO: 95) |

In some embodiments, the bispecific binding protein has a 4-1BB binding domain with amino acid sequences of the CDRs of:

| CDR | Sequence (N→C) | Identifier |
| --- | --- | --- |
| $V_H$ CDR#1 | GYTFTSYYIY | (SEQ ID NO: 280) |
| $V_H$ CDR#2 | NIWPGNGGTFYGEKFMG | (SEQ ID NO: 281) |
| $V_H$ CDR#3 | RPDYSGDDYFDY | (SEQ ID NO: 282) |
| $V_L$ CDR#1 | KLNSGNIGSYYVH | (SEQ ID NO: 283) |
| $V_L$ CDR#2 | RDDKRPD | (SEQ ID NO: 284) |
| $V_L$ CDR#3 | HSYDSTITPV | (SEQ ID NO: 285) |

In some embodiments, the bispecific binding protein has a 4-1BB binding domain comprising a $V_H$ according to any one of SEQ ID NO:69-72 and a $V_L$ according to any one of SEQ ID NO:89-95. In some embodiments, the bispecific binding protein has a 4-1BB binding domain comprising a $V_H$ according to SEQ ID NO:69 and a $V_L$ according to SEQ ID NO:89. In some embodiments, the bispecific binding protein has a 4-1BB binding domain comprising a $V_H$ according to SEQ ID NO:69 and a $V_L$ according to SEQ ID NO:90. In some embodiments, the bispecific binding protein has a 4-1BB binding domain comprising a $V_H$ according to SEQ ID NO:70 and a $V_L$ according to SEQ ID NO:90. In some embodiments, the bispecific binding protein has a 4-1BB binding domain comprising a $V_H$ according to SEQ ID NO:69 and a $V_L$ according to SEQ ID NO:91. In some embodiments, the bispecific binding protein has a 4-1BB binding domain comprising a $V_H$ according to SEQ ID NO:69 and a $V_L$ according to SEQ ID NO:92. In some embodiments, the bispecific binding protein has a 4-1BB binding domain comprising a $V_H$ according to SEQ ID NO:69 and a $V_L$ according to SEQ ID NO:93. In some embodiments, the bispecific binding protein has a 4-1BB binding domain comprising a $V_H$ according to SEQ ID NO:70 and a $V_L$ according to SEQ ID NO:89. In some embodiments, the bispecific binding protein has a 4-1BB binding domain comprising a $V_H$ according to SEQ ID NO:70 and a $V_L$ according to SEQ ID NO:91. In some embodiments, the bispecific binding protein has a 4-1BB binding domain comprising a $V_H$ according to SEQ ID NO:70 and a $V_L$ according to SEQ ID NO:92. In some embodiments, the bispecific binding protein has a 4-1BB binding domain comprising a $V_H$ according to SEQ ID NO:70 and a $V_L$ according to SEQ ID NO:93. In some embodiments, the bispecific binding protein has a 4-1BB binding domain comprising a $V_H$ according to SEQ ID NO:71 and a $V_L$ according to SEQ ID NO:94. In some embodiments, the bispecific binding protein has a 4-1BB binding domain comprising a $V_H$ according to SEQ ID NO:71 and a $V_L$ according to SEQ ID NO:95. In some embodiments, the bispecific binding protein has a 4-1BB binding domain comprising a $V_H$ according to SEQ ID NO:72 and a $V_L$ according to SEQ ID NO:94. In some embodiments, the bispecific binding protein has a 4-1BB binding domain comprising a $V_H$ according to SEQ ID NO:72 and a $V_L$ according to SEQ ID NO:95.

Certain mutations of a $V_H$ or $V_L$ sequence in an immunomodulatory binding region described in Section 7.3.2 herein would be understood by a person of skill to afford bispecific binding proteins within the scope of the disclosure. Mutations may include amino acid substitutions, additions, or deletions from a $V_H$ or $V_L$ sequence as disclosed herein while retaining significant activity toward an immunomodulatory protein. Accordingly, in some embodiments, a bispecific binding protein comprises a $V_H$ sequence having at least 85%, at least 90%, at least 93%, at least 95%, at least 96%, at least 97%, at least 98%, or at least 99% sequence identity to any one of the $V_H$ sequences shown in Section 7.3.2. A bispecific binding protein can comprise a $V_H$ sequence having up to 8, up to 7, up to 6, up to 5, up to 4, up to 3, or up to 2 mutations compared with any one of the $V_H$ sequences shown in Section 7.3.2. In some embodiments, a bispecific binding protein can comprise a $V_H$ sequence having 5 or fewer, 4 or fewer, 3 or fewer, or 2 or fewer mutations compared with any one of the $V_H$ sequences shown in Section 7.3.2. In some embodiments, a bispecific binding protein comprises a $V_L$ sequence having at least 85%, at least 90%, at least 93%, at least 95%, at least 96%, at least 97%, at least 98%, or at least 99% sequence identity to any one of the $V_L$ sequences shown in Section 7.3.2. A bispecific binding protein can comprise a $V_L$ sequence having up to 8, up to 7, up to 6, up to 5, up to 4, up to 3, or up to 2 mutations compared with any one of the $V_L$ sequences shown in Section 7.3.2. In some embodiments, a bispecific binding protein can comprise a $V_L$ sequence having 5 or fewer, 4 or fewer, 3 or fewer, or 2 or fewer mutations compared with any one of the $V_L$ sequences shown in Section 7.3.2.

7.3.3. Tumor Antigen Binding Proteins

In another aspect, the bispecific binding protein of the disclosure selectively binds to a tumor antigen. Cell-surface tumor antigens are expressed on the cell membranes of solid tumors, including any of the solid tumors described herein. Appropriate tumor antigens include CSF1R, Ly86, MS4A7, CD74, CCR5, COL7A1, LOX, LRRC15, SERPINE1, TGFBR1, VEGF-A, VEGFR, ANGPTL4, EGLN, IFI6, KISS1R, PDK1, CADM1, COL6A3, KRT33A, LUM, WNT5A, MMP14, CDCP1, PDGFRA, ADGRE1, MHC-Class II, HLA-DR, TCRαβ, TCRγδ, PD-1, PD-L1, CTLA-4, MUC1, MUC16, CA15-3, CA19-9, CA-195, CA-549, cathepsin-D, CEACAM5, CEACAM6, ERBB2, EGFR, ENO2, ALPP, PLP1, DLL3, SLC34A2, PTK7, B7-H3, LIV-1, STEAP1, TACSTD2, GPNMB, 5T4, CD142, TIM1, CDH3, LGR5, LYPD3, TGDF1, B7-H4, mesothelin, nectin-4, and PSMA. In specific embodiments, a tumor antigen is selected from mesothelin, B7-H4, nectin-4, PSMA, PD-L1, EGFR and VEGFR. In certain embodiments, a tumor antigen is selected from mesothelin, B7-H4, nectin-4, PSMA and EGFR.

For some uses, it is desirable to have bispecific binding proteins with high affinity to a tumor antigen. For certain uses, such as therapeutic uses, an affinity, e.g., $K_D$, of at least about 100 nM is desirable. For applications in which specific affinities are desired, bispecific binding proteins specifically bind a tumor antigen with an affinity of at least about 100 nM, or even higher, for example, at least about 90 nM, 80 nM, 70 nM, 60 nM, 50 nM, 40 nM, 30 nM, 25 nM, 20 nM, 15 nM, 10 nM, 7 nM, 6 nM, 5 nM, 4 nM, 3 nM, 2 nM, 1 nM, 0.1 nM, 0.01 nM, or greater. In some embodiments, the $K_D$ to a tumor antigen is in a range bounded by any two of the foregoing values, e.g., from about 0.1 to about 100 nM, such as 1 to 100, 0.1 to 50, 2 to 90, or about 0.1 to 80 nM.

In a specific embodiment, a bispecific binding protein of the disclosure has affinity to and agonizes CD40, and has high affinity to mesothelin. In another specific embodiment, a bispecific binding protein of the disclosure has affinity to and agonizes CD40, and has high affinity to prostate-specific membrane antigen (PSMA). In yet another specific embodiment, a bispecific binding protein of the disclosure has affinity to and agonizes CD40, and has high affinity to epidermal growth factor receptor (EGFR). In an additional specific embodiment, a bispecific binding protein of the disclosure has affinity to and agonizes CD40, and has high affinity to nectin-4. In another embodiment, a bispecific binding protein disclosed herein has affinity to and agonizes 4-1BB, and has high affinity to mesothelin. In another embodiment, a bispecific binding protein disclosed herein has affinity to and agonizes 4-1BB, and has high affinity to B7-H4. In another embodiment, a bispecific binding protein disclosed herein has affinity to and agonizes 4-1BB, and has high affinity to PSMA.

Affinity of binding proteins that bind an immunomodulatory protein and a tumor antigen can be determined using techniques well known in the art or described herein, such as for example, ELISA, isothermal titration calorimetry (ITC), surface plasmon resonance, or fluorescent polarization assay.

In a specific embodiment, the bispecific binding proteins of the disclosure binds to CD40 and mesothelin. In another specific embodiment, a bispecific binding protein of the disclosure binds to CD40 and prostate-specific membrane antigen (PSMA). In yet another specific embodiment, a bispecific binding protein of the disclosure binds to CD40 and epidermal growth factor receptor (EGFR). In an additional specific embodiment, a bispecific binding protein of the disclosure binds to CD40 and nectin-4. In another specific embodiment, the bispecific binding protein binds to 4-1BB and mesothelin. In another specific embodiment, the bispecific binding protein binds to 4-1BB and B7-H4. In yet another specific embodiment, the bispecific binding protein binds to 4-1BB and PSMA.

In an illustrative embodiment, when the immunomodulatory protein is CD40 and X is scFv$^X$, the bispecific binding protein of formula (I) comprises scFv$^X$ binding CD40 and scFv$^Y$ binding mesothelin. In certain embodiments, when the immunomodulatory protein is CD40 and X is scFv$^X$, the bispecific binding protein of formula (I) comprises scFv$^X$ binding mesothelin and scFv$^Y$ binding CD40. In certain embodiments, when the immunomodulatory protein is CD40 and X is Fab, the bispecific binding protein of formula (I) comprises Fab binding mesothelin and scFv$^Y$ binding CD40.

In an illustrative embodiment, when the immunomodulatory protein is CD40, the polypeptide of formula (II) comprises scFv$^X$ binding CD40 and scFv$^Y$ binding mesothelin. In certain embodiments, when the immunomodulatory protein is CD40, the polypeptide of formula (II) comprises scFv$^X$ binding mesothelin and scFv$^Y$ binding CD40.

In an illustrative embodiment, when the immunomodulatory protein is CD40, the polypeptide of formula (III) comprises Fab binding mesothelin and scFv$^Y$ binding CD40.

In an illustrative embodiment, when the immunomodulatory protein is CD40, the polypeptide of formula (IV) comprises V$_H$-CH1, when combined with a peptide comprising V$_L$-CL, binding mesothelin, and scFv$^Y$ binding CD40.

In some embodiments, the bispecific binding proteins compete for binding human mesothelin on cells expressing mesothelin in in vitro assays with a reference antibody. The reference antibody may be any of the anti-mesothelin antibodies described herein or known in the art. In some embodiments, the reference antibody is an antibody provided in TABLE 2-1. In specific embodiments, the reference antibody is selected from antibody HuAb17 ("HuAb17"); antibody HuAM1 ("HuAM1"); antibody HuAM2 ("HuAM2"); antibody HuAM3 ("HuAM3"); antibody HuAM4 ("HuAM4"); antibody HuAM5 ("HuAM5"); antibody HuAM6 ("HuAM6"); antibody HuAM7 ("HuAM7"); antibody HuAM8 ("HuAM8"); antibody HuAM9 ("HuAM9"); antibody HuAM11 ("HuAM11"); antibody HuAM12 ("HuAM12"); antibody HuAM13 ("HuAM13"); antibody HuAM14 ("HuAM14"); antibody HuAM15 ("HuAM15"); antibody HuAM17 ("HuAM17"); antibody HuAM18 ("HuAM18"); antibody HuAM19 ("HuAM19"); and antibody HuAM21 ("HuAM21"). In a specific embodiment, the reference antibody is HuAM15.

In some embodiments, a bispecific binding protein of the disclosure, e.g., a protein of formula (I), is suitable for administration to humans. In a specific embodiment, the bispecific binding protein comprises human tumor antigen-binding domains. In another specific embodiment, the bispecific binding protein comprises a tumor antigen binding region comprising a V$_H$ sequence selected from the following sequences (CDR sequences in bold):

| V$_H$ | Sequence (N→C) | Identifier |
|---|---|---|
| HuAb17 V$_H$ | EVQLVQSGAEVKEPGASVKVSCKASGDTFNRYYVHWARQAPG QGLEWMGIINPSGVSTTYAQKFQGRVTMTRDTPTNTVYMELGS LRPEDTAVYFCAESRGSGYNYFAMDVWGQGTLVTVSS | (SEQ ID NO: 107) |
| HuAM1 V$_H$ | EVQLVQSGAEVKKPGASVKVSCKASGDTFKRYYVQWVRQAPG QGLEWMGIINPSGVSTTYAQKFQGRVTMTRDTSTSTVYMELSS LRSEDTAVYYCAESRGSGYNYFAMDVWGQGTLVTVSS | (SEQ ID NO: 108) |
| HuAM2 V$_H$ | EVQLVQSGAEVKKPGASVKVSCKASGYTFKRYYVHWVRQAPG QGLEWMGIINPSGVSTTYAQKFQGRVTMTRDTSTSTVYMELSS LRSEDTAVYYCAESRGSGYNYFAMDVWGQGTLVTVSS | (SEQ ID NO: 109) |
| HuAM3 V$_H$ | EVQLVQSGAEVKKPGASVKVSCKASGDTFKRYYVHWVRQAPG QGLEWMGIINPSGVSTTYAQKFQGRVTMTRDTSTSTVYMELSS LRSEDTAVYYCAESRGSGYNYFAMDVWGQGTLVTVSS | (SEQ ID NO: 110) |
| HuAM4 V$_H$ | EVQLVQSGAEVKKPGASVKVSCKASGDTFNRYYVHWVRQAPG QGLEWMGIINPSGVSTTYAQKFQGRVTMTRDTSTSTVYMELSS LRSEDTAVYYCAESRIPGYNNFAMDVWGQGTLVTVSS | (SEQ ID NO: 111) |
| HuAM5 V$_H$ | EVQLVQSGAEVKKPGASVKVSCKASGDTFNRYYVHWVRQAPG QGLEWMGIINPSGVSTTYAQKFQGRVTMTRDTSTSTVYMELSS LRSEDTAVYYCAEVRGSGYNYFAMDVWGQGTLVTVSS | (SEQ ID NO: 112) |

| V_H | Sequence (N→C) | Identifier |
|---|---|---|
| HuAM6 V_H | EVQLVQSGAEVKKPGASVKVSCKASGDTFNRYYVHWVRQAPG QGLEWMGIINPSGVSTTYAQKFQGRVTMTRDTSTSTVYMELSS LRSEDTAVYYCAESRVPGYNNFAMDVWGQGTLVTVSS | (SEQ ID NO: 113) |
| HuAM7 V_H | EVQLVQSGAEVKKPGASVKVSCKASGDTFNRYYVHWVRQAPG QGLEWMGIINPSGVSTTYAQKFQGRVTMTRDTSTSTVYMELSS LRSEDTAVYYCAEVRGSGYNYFGMDVWGQGTLVTVSS | (SEQ ID NO: 114) |
| HuAM8 V_H | EVQLVQSGAEVKKPGASVKVSCKASGDTFNRYYVHWVRQAPG QGLEWMGIINPSGVSTTYAQKFQGRVTMTRDTSTSTVYMELSS LRSEDTAVYYCAESRGSGYNYFAMDVWGQGTLVTVSS | (SEQ ID NO: 115) |
| HuAM9 V_H | EVQLVQSGAEVKKPGASVKVSCKASGDTFNRYYVQWVRQAPG QGLEWMGIINPSGVSTTYAQKFQGRVTMTRDTSTSTVYMELSS LRSEDTAVYYCAETRGSGYNYFGMDVWGQGTLVTVSS | (SEQ ID NO: 116) |
| HuAM11 V_H | EVQLVQSGAEVKKPGASVKVSCKASGDTFKRYYMHWVRQAPG QGLEWMGIINPSGVSTTYAQKFQGRVTMTRDTSTSTVYMELSS LRSEDTAVYYCAEVRGSGFNYFGMDVWGQGTLVTVSS | (SEQ ID NO: 117) |
| HuAM12 V_H | EVQLVQSGAEVKKPGASVKVSCKASGDTFHRYYVHWVRQAPG QGLEWMGIINPSGVSTTYAQKFQGRVTMTRDTSTSTVYMELSS LRSEDTAVYYCAEVRGSGFNYFGMDVWGQGTLVTVSS | (SEQ ID NO: 118) |
| HuAM13 V_H | EVQLVQSGAEVKKPGASVKVSCKASGDTFNRYYVQWVRQAPG QGLEWMGIINPSGVSTTYAQKFQGRVTMTRDTSTSTVYMELSS LRSEDTAVYYCAETRGSGFNYFGMDVWGQGTLVTVSS | (SEQ ID NO: 119) |
| HuAM15 V_H | EVQLVQSGAEVKKPGASVKVSCKASGDTFKRYYVHWVRQAPG QGLEWMGIINPSGVSTTYAQKFQGRVTMTRDTSTSTVYMELSS LRSEDTAVYYCAEVRGSGFNYFGMDVWGQGTLVTVSS | (SEQ ID NO: 120) |
| HuAM17 V_H | EVQLVQSGAEVKKPGASVKVSCKASGDTFNRYYVQWVRQAPG QGLEWMGIINPSGVSTTYAQKFQGRVTMTRDTSTSTVYMELSS LRSEDTAVYYCAESRVPGYNIFAMDVWGQGTLVTVSS | (SEQ ID NO: 121) |
| HuAM18 V_H | EVQLVQSGAEVKKPGASVKVSCKASGDTFNRYYVHWVRQAPG QGLEWMGIINPSGVSTTYAQKFQGRVTMTRDTSTSTVYMELSS LRSEDTAVYYCAETRGSGYNYFGMDVWGQGTLVTVSS | (SEQ ID NO: 122) |
| HuAM19 V_H | EVQLVQSGAEVKKPGASVKVSCKASGDTFKRYYAHWVRQAPG QGLEWMGIINPSGVSTTYAQKFQGRVTMTRDTSTSTVYMELSS LRSEDTAVYYCAESRLPGYNAFAMDVWGQGTLVTVSS | (SEQ ID NO: 123) |
| HuAM21 V_H | EVQLVQSGAEVKKPGASVKVSCKASGDTFNRYYVQWVRQAPG QGLEWMGIINPSGVSTTYAQKFQGRVTMTRDTSTSTVYMELSS LRSEDTAVYYCAETRGPGFNYFGMDVWGQGTLVTVSS | (SEQ ID NO: 124) |
| HuAM15 Stab2 V_H | EVQLVQSGAGLVQPGGSVRVSCAASGFTFKRYYVHWVRQAPG KGLEWMGIINPSGVSTTYAQKFQGRVTISRDNSKNTLYMQLNS LRAEDTAVYYCARVRGSGFNYFGMDVWGQGTLVTVSS | (SEQ ID NO: 125) |
| HuAM15 Stab3 V_H | EVQLVESGAGLVKPGESVKVSCAASGFTFKRYYVHWVRQAPG KGLEWMGIINPSGVSTTYAQKFQGRVTISRDNSTNTLYMELNSL RAEDTAVYYCARVRGSGFNYFGMDVWGQGTLVTVSS | (SEQ ID NO: 126) |
| HuAM15 Stab4 V_H | EVQLVESGAGVVKPGESVKVSCAASGFTFKRYYVHWVRQAPG KGLEWMGIINPSGVSTTYAQKFQGRVTMSRDTSTSTVYMELNS LRAEDTAVYYCARVRGSGFNYFGMDVWGQGTLVTVSS | (SEQ ID NO: 127) |
| HuAM15 Stab VH3 V_H | EVQLVESGGGLVQPGGSLRLSCAASGFTFKRYYVHWVRQAPGK GLEWVGIINPSGVSTTYAQKFQGRFTISRDNSKNTLYLQMNSLR AEDTAVYYCARVRGSGFNYFGMDVWGQGTLVTVSS | (SEQ ID NO: 128) |
| MSLN76923 V_H | EVQLLESGGGLVQPGGSLRLSCAASGFTESSYAMSWVRQAPGK GLEWVSAISGGGGRTYYADSVKGRFTISRDNSKNTLYLQMNSL RAEDTAVYYCAREEMAFRAYRFDIWGQGTLVTVSS | (SEQ ID NO: 129) | and the amino acid sequence of the corresponding $V_L$ sequence is selected from the following sequences (CDR sequences in bold):

| $V_L$ | Sequence (N→C) | Identifier |
|---|---|---|
| HuAb17 $V_L$ | SYELTQPPSVSVSPGQTADITCSGDKLGDKYASWYQQKPGQSPV LVIYQDNRRPSGIPERFSGSNSGNTATLTISGTQAMDEADYYCQA WDSDTYVFGPGTKVTVL | (SEQ ID NO: 136) |
| HuAM1 $V_L$ | SYELTQPPSVSVSPGQTASITCSGDKLGDKYASWYQQKPGQSPV LVIYQDNRRPSGIPERFSGSNSGNTATLTISGTQAMDEADYYCQA WDSDTYVFGTGTKVTVL | (SEQ ID NO: 137) |
| HuAM8 $V_L$ | SYELTQPPSVSVSPGQTASITCSGDNLGYKYVSWYQQKPGQSPV LVIYQDHRRPSGIPERFSGSNSGNTATLTISGTQAMDEADYYCQA WDTDTYVFGTGTKVTVL | (SEQ ID NO: 138) |
| HuAM11 $V_L$ | SYELTQPPSVSVSPGQTASITCSGDKLGDKYASWYQQKPGQSPV LVIYQDNRRPSGIPERFSGSNSGNTATLTISGTQAMDEADYYCQV WDSDTYVFGTGTKVTVL | (SEQ ID NO: 139) |
| HuAM19 $V_L$ | SYELTQPPSVSVSPGQTASITCSGDMLGYQYGSWYQQKPGQSPV LVIYQDNRRPSGIPERFSGSNSGNTATLTISGTQAMDEADYYCQA WDGDAFVFGTGTKVTVL | (SEQ ID NO: 140) |
| HuAM15 Stab VL3 $V_L$ | SYELTQPPSVSVAPGQTARISCSGDKLGDKYASWYQQKPGQAPV LVIYQDNRRPSGIPERFSGSNSGNTATLTISGTQAEDEADYYCQA WDSDTYVFGGGTKLTVL | (SEQ ID NO: 141) |
| HuAM15 Stab VK $V_L$ | DIQMTQSPSSLSASVGDRVTITCSGDKLGDKYASWYQQKPGKAP KLLIYQDNRRPSGVPSRFSGSGSGTDFTLTISSLQPEDFATYYCQA WDSDTYVFGQGTKVEIK | (SEQ ID NO: 142) |
| MSLN76923 $V_L$ | DIQMTQSPSSLSASVGDRVTITCRASQSISSYLNWYQQKPGKAPK LLIYAASSLQSGVPSRFSGSGSGTDFTLTISSLQPEDFATYYCQQS YITPLTFGGGTKVEIK | (SEQ ID NO: 143) |

In some embodiments, the bispecific binding protein has a mesothelin binding domain with amino acid sequences of the CDRs of:

| CDR | Sequence (N→C) | Identifier |
|---|---|---|
| $V_H$ CDR#1 | GDTFKRYYVH | (SEQ ID NO: 241) |
| $V_H$ CDR#2 | IINPSGVSTTYAQKFQG | (SEQ ID NO: 242) |
| $V_H$ CDR#3 | VRGSGFNYFGMDV | (SEQ ID NO: 243) |
| $V_L$ CDR#1 | SGDKLGDKYAS | (SEQ ID NO: 244) |
| $V_L$ CDR#2 | QDNRRPS | (SEQ ID NO: 245) |
| $V_L$ CDR#3 | QAWDSDTYV | (SEQ ID NO: 246) |

In some embodiments, the bispecific binding protein has a mesothelin binding domain comprising a $V_H$ according to SEQ ID NO:107 and a $V_L$ according to SEQ ID NO:136. In some embodiments, the bispecific binding protein has a mesothelin binding domain comprising a $V_H$ according to SEQ ID NO:108 and a $V_L$ according to SEQ ID NO:137. In some embodiments, the bispecific binding protein has a mesothelin binding domain comprising a $V_H$ according to SEQ ID NO:109 and a $V_L$ according to SEQ ID NO:137. In some embodiments, the bispecific binding protein has a mesothelin binding domain comprising a $V_H$ according to SEQ ID NO:110 and a $V_L$ according to SEQ ID NO:137. In some embodiments, the bispecific binding protein has a mesothelin binding domain comprising a $V_H$ according to SEQ ID NO:111 and a $V_L$ according to SEQ ID NO:137. In some embodiments, the bispecific binding protein has a mesothelin binding domain comprising a $V_H$ according to SEQ ID NO:112 and a $V_L$ according to SEQ ID NO:137. In some embodiments, the bispecific binding protein has a mesothelin binding domain comprising a $V_H$ according to SEQ ID NO:113 and a $V_L$ according to SEQ ID NO:137. In some embodiments, the bispecific binding protein has a mesothelin binding domain comprising a $V_H$ according to SEQ ID NO:114 and a $V_L$ according to SEQ ID NO:137. In some embodiments, the bispecific binding protein has a mesothelin binding domain comprising a $V_H$ according to SEQ ID NO:115 and a $V_L$ according to SEQ ID NO:138. In some embodiments, the bispecific binding protein has a mesothelin binding domain comprising a $V_H$ according to SEQ ID NO:116 and a $V_L$ according to SEQ ID NO:137. In some embodiments, the bispecific binding protein has a mesothelin binding domain comprising a $V_H$ according to SEQ ID NO:117 and a $V_L$ according to SEQ ID NO:139. In some embodiments, the bispecific binding protein has a mesothelin binding domain comprising a $V_H$ according to SEQ ID NO:118 and a $V_L$ according to SEQ ID NO:137. In some embodiments, the bispecific binding protein has a mesothelin binding domain comprising a $V_H$ according to SEQ ID NO:119 and a $V_L$ according to SEQ ID NO:139. In some embodiments, the bispecific binding protein has a mesothelin binding domain comprising a $V_H$ according to SEQ ID NO:117 and a $V_L$ according to SEQ ID NO:137. In some embodiments, the bispecific binding protein has a mesothelin binding domain comprising a $V_H$ according to SEQ ID NO:120 and a $V_L$ according to SEQ ID NO:137. In some embodiments, the bispecific binding protein has a mesothelin binding domain comprising a $V_H$ according to SEQ ID NO:119 and a $V_L$ according to SEQ ID NO:137. In some embodiments, the bispecific binding protein has a mesothelin binding domain comprising a $V_H$ according to SEQ ID NO:120 and a $V_L$ according to SEQ ID NO:141. In some embodiments, the bispecific binding protein has a mesothelin binding domain comprising a $V_H$ according to SEQ ID NO:121 and a $V_L$ according to SEQ ID NO:137. In some embodiments, the bispecific binding protein has a mesothelin binding domain comprising a $V_H$ according to SEQ ID NO:122 and a $V_L$ according to SEQ ID NO:137. In some embodiments, the bispecific binding protein has a mesothelin binding domain comprising a $V_H$ according to SEQ ID NO:123 and a $V_L$ according to SEQ ID NO:140. In some embodiments, the bispecific binding protein has a mesothelin binding domain comprising a $V_H$ according to SEQ ID NO:124 and a $V_L$ according to SEQ ID NO:137. In some embodiments, the bispecific binding protein has a mesothelin binding domain comprising a $V_H$ according to SEQ ID NO:129 and a $V_L$ according to SEQ ID NO:143.

In some embodiments, the bispecific binding proteins compete for binding human nectin-4 on cells expressing nectin-4 in in vitro assays with a reference antibody. The reference antibody may be any of the anti-nectin-4 antibodies described herein or known in the art.

In some embodiments, a bispecific binding protein of the disclosure comprises a nectin-4 binding region comprising a $V_H$ sequence of (CDR sequences in bold):

| $V_H$ | Sequence (N→C) | Identifier |
|---|---|---|
| 66.3 $V_H$ | QVQLQQSGPELVKPGASVRISCKASGYTFTTYYIHWVKQRPGQGLEWIGWIYPGNVNTNYNEKFKGKATLTADKSSSTAYMQLTSLTSEDSAVYFCARGVYYFDYWGQGTILTVSS | (SEQ ID NO: 151) | and a $V_L$ sequence of (CDR sequences in bold):

| $V_L$ | Sequence (N→C) | Identifier |
|---|---|---|
| 66.3 $V_L$ | SIVMTQTPKFLLVSAGDRVTITCKASQSVNNDVSWFQQKPGQSPTLLIYYASNRYTGVPDRFTGSGYGTDFTFTISTVQAEDLAVYFCQQDYSSPYTFGGGTKLEIK | (SEQ ID NO: 161) |

In some embodiments, the bispecific binding proteins compete for binding human epidermal growth factor receptor (EGFR) on cells expressing epidermal growth factor receptor in in vitro assays with a reference antibody. The reference antibody may be any of the anti-EGFR antibodies described herein or known in the art.

In some embodiments, a bispecific binding protein of the disclosure comprises an EGFR binding region comprising a $V_H$ sequence of (CDR sequences in bold):

| $V_H$ | Sequence (N→C) | Identifier |
|---|---|---|
| Hu225-G30Y $V_H$ | EVQLVESGGGLVQPGGSLRLSCAASGFSLTNYGVHWVRQAPGKGLEWLGVIWSGGNTDYNTPFTSRLTINKDNSKNTVYLQMNSLRAEDTAVYYCARALTYYDYEFAYWGQGTLVTVSS | (SEQ ID NO: 171) | and a $V_L$ sequence of (CDR sequences in bold):

| $V_L$ | Sequence (N→C) | Identifier |
|---|---|---|
| Hu225-G30Y $V_L$ | DILLTQSPGTLSLSPGERATLSCRASQSIYTNIHWYQQKPGQAPRLLIKYASESISGIPDRFSGSGSGTDFTLTISRLEPEDFAVYYCQQNNNWPTTFGQGTKLEIK | (SEQ ID NO: 181) |

In some embodiments, the bispecific binding proteins compete for binding human prostate-specific membrane antigen (PSMA) on cells expressing prostate-specific membrane antigen in in vitro assays with a reference antibody. The reference antibody may be any of the anti-PSMA antibodies described herein or known in the art. In some embodiments, the reference antibody is a humanized version of an anti-PSMA antibody as described herein, e.g., an antibody having the $V_H$ and $V_L$ sequences shown in FIGS. 10A, 10J, and 10K.

In some embodiments, a bispecific binding protein of the disclosure comprises a PSMA binding region comprising a $V_H$ sequence selected from the following sequences (CDR sequences in bold):

| $V_H$ | Sequence (N→C) | Identifier |
|---|---|---|
| SAM3.1 $V_H$ | DVQLQESGPGLVKPSQSLSLTCSVTGYSITSGYYWNWIRQFR GSKLEWMGYISYDGNNNYNPSLKNRISITRDTSKNQFFLKLN SVTTEDTATYYCARERYYDYDGYAVDYWGQGTSVTVSS | (SEQ ID NO: 191) |
| SAM103 $V_H$ | EVKLVESEGGLVQPGSSMKLSCTASGFTESDYYMAWVRQVR EKGLEWVANINYDGTTTYYLDSLKSRFIISRDNSKNILYLQM SSLKSEDTATYYCARVLDGYYGYFDYWGQGTTLSVSS | (SEQ ID NO: 192) |
| SAM4.1 $V_H$ | DVKLVESGEGLVKPGGSLKLSCAASGFTESSYAMSWVRQTPE KRLEWVAYISSGGDYIYYADTMKGRFTISRDNARNTLYLQM SSLKSEDTAMYYCTRVFDGYYARFLYWGQGTLVTVSA | (SEQ ID NO: 193) |
| SAM5.1 $V_H$ | QVTLKESGPGILQSSQTLSLTCSFSGFSLSTSGMGVSWIRQPSG KGLEWLAHIYWDDDQRYNPSLKSRLTISKDASGNQVFLKITS VDTADTATYYCTRRGGYGSSKGYYYVMDYWGQGTSVTVSS | (SEQ ID NO: 194) |
| SAM13.1 $V_H$ | QVQLQQRGAELVKPGASVKVSCKASGYTFTNYWMHWVKQ RPGQGLEWIGRIHPSDSDTNYNQRFKGKATLTVDKSSTTAY MQLSSLTSEDSAVYYCAIEDYSNYVDFDVWGTGTTVTVSS | (SEQ ID NO: 195) |
| SAM16.2 $V_H$ | QTQLVQSGPELKKPGETVKISCKASGYTETTYGVSWVKQAPG KGLKWMGWINTYSGVPTYADDFKGRFAFSLETSASTAYLQI TNLKNEDTATYFCARQEAFYNRTMDYWGQGTSVTVSS | (SEQ ID NO: 196) |
| SAM17.1 $V_H$ | EVQLQQSGPVLVKPGASVKMSCKASGYTFTDYYMNWVKQS HGKSLEWIGLINPNSGGINYNQKFKVKATLTVDKSSTAYME LNSLTSEDSAVYYCARRDYGTSGDYWGQGTSVTVSS | (SEQ ID NO: 197) | and the amino acid sequence of the corresponding $V_L$ sequence is selected from the following sequences (CDR sequences in bold):

| $V_L$ | Sequence (N→C) | Identifier |
|---|---|---|
| SAM3.1 $V_L$ | DIQMTQSPASLSVSVGETVTITCRASENIYSNLAWYQQKQGK SPQLLVYGATNLADGVTSRFSGSGSGTQYSLKINSLQSEDFGS YYCQNFWGTTWTFGGGTKLEIK | (SEQ ID NO: 201) |
| SAM103 $V_L$ | QIVLTQSPAIMSASPGEKVTISCSASSSVSYMYWYQQKPGSSP KPWIYRTYNLASGVPARFSGSGSGTSYSLTISSMEAEDAATYY CQQSHTYPPTFGGGTKLEIK | (SEQ ID NO: 202) |
| SAM4.1 $V_L$ | DIVMTQSQKFMSTSVGDRVSVTCKASQNVDTNVAWYQQKP GQSPKALIYSTSYRYSGVPDRFTGSGSGTDFTLTINNVQSEDL AEYFCQQYNNYPLTFGTGTKLELK | (SEQ ID NO: 203) |
| SAM5.1 $V_L$ | DIQMTQSPSSLSASLGERVSLTCRASQHIGTRLNWLQQEPDG TIKRLIYATSSLDSGVPKRFSGSRSGSVYSLTISSLESEDFVDYY CVQYASSPYTFGGGTKLEIK | (SEQ ID NO: 204) |
| SAM13.1 $V_L$ | DILLTQSPASLAVSLGQRATISCRASESVDTYGITFIHWYQQK PGQPPKWYRASNLESGIPARFSGSGSKTDFTLTINPVETDDV ATYYCQQNNKDPRTFGGGTKLEIR | (SEQ ID NO: 205) |
| SAM16.2 $V_L$ | ENVLTQSPAIMSASPGEKVTMTCRASSSVSSSYLHWYQQKSG ASPKLWIYSRSTLASGVPARFSGSGSGTSYSLTISSVEAEDAAT YYCQQYRGYPLTFGSGTKLEIK | (SEQ ID NO: 206) |
| SAM17.1 $V_L$ | DIQMNQSPSSLSASLGDTITITCHASQNINVWLSWYQQKFGNI PKWYKASNLHTGVPSRFSGSGSGTGFTLTISSLQPEDIATYY CQQGQSYPLTFGAGTKLELK | (SEQ ID NO: 207) |

In some embodiments, the bispecific binding protein has a PSMA binding domain comprising a $V_H$ according to SEQ ID NO:191 and a $V_L$ according to SEQ ID NO:201. In some embodiments, the bispecific binding protein has a PSMA binding domain comprising a $V_H$ according to SEQ ID NO:192 and a $V_L$ according to SEQ ID NO:202. In some embodiments, the bispecific binding protein has a PSMA binding domain comprising a $V_H$ according to SEQ ID NO:193 and a $V_L$ according to SEQ ID NO:203. In some embodiments, the bispecific binding protein has a PSMA binding domain comprising a $V_H$ according to SEQ ID NO:194 and a $V_L$ according to SEQ ID NO:204. In some embodiments, the bispecific binding protein has a PSMA binding domain comprising a $V_H$ according to SEQ ID NO:195 and a $V_L$ according to SEQ ID NO:205. In some embodiments, the bispecific binding protein has a PSMA binding domain comprising a $V_H$ according to SEQ ID NO:196 and a $V_L$ according to SEQ ID NO:206. In some embodiments, the bispecific binding protein has a PSMA binding domain comprising a $V_H$ according to SEQ ID NO:197 and a $V_L$ according to SEQ ID NO:207.

In some embodiments, the bispecific binding proteins compete for binding B7-H4 on cells expressing B7-H4 in in vitro assays with a reference antibody. The reference antibody may be any of the anti-B7-H4 antibodies described herein or known in the art. In some embodiments, the reference antibody is a humanized version of an anti-B7-H4 antibody as described herein, e.g., an antibody having the $V_H$ and $V_L$ sequences shown in FIGS. 10E-10G.

In some embodiments, a bispecific binding protein of the disclosure comprises a B7-H4 binding region comprising a $V_H$ sequence selected from the following sequences (CDR sequences in bold):

| $V_H$ | Sequence (N→C) | Identifier |
| --- | --- | --- |
| mu182.19.1 $V_H$ | QVQLRQPGAELVKPGASVKLSCKTSGYTFTSYWMHWVKQRP GQGLEWIGEIDPSDSYINYNQKFKGEATLTVDKSSSTAYMQLS SLTSEDSAVYYCARGPRDYWGQGTTLTVSS | (SEQ ID NO: 211) |
| mu182.17.1 $V_H$ | QVQLQQSGAELARPGASVKLSCKASGYTFTTYWMQWVKQRP GQGLEWIGAIYPGDGDTRYTQKFKGKATLTADKSSSTAYMQL SSLASEDSAVYYCARGRDYSGSSWTWFAYWGQGTLVTVSA | (SEQ ID NO: 212) |
| hu182.19.1 1a $V_H$ | EVQLVQSGAEVKKPGSSVKVSCKTSGYTFTSYWMHWVRQAP GQGLEWIGEIDPSDSYINYNQKFKGRATLTVDKSTSTAYMELS SLRSEDTAVYYCARGPRDYWGQGTTVTVSS | (SEQ ID NO: 213) |
| hu182.17.1 1b $V_H$ | EVQLVQSGAEVKKPGSSVKVSCKASGYTFTTYWMQWVRQAP GQGLEWMGAIYPGDGDTRYTQKFKGRVTLTADKSTSTAYME LSSLRSEDTAVYYCARGRDYSGSSWTWFAYWGQGTLVTVSS | (SEQ ID NO: 214) |
| hu182.19.1 1b $V_H$ | EVQLVQSGAEVKKPGSSVKVSCKASGYTFTSYWMHWVRQAP GQGLEWMGEIDPSDSYINYNQKFKGRVTLTVDKSTSTAYMEL SSLRSEDTAVYYCARGPRDYWGQGTTVTVSS | (SEQ ID NO: 215) |
| mu182.10.21 $V_H$ | EVKLVESGGGLVQPGGSVRLSCATSGFTFSDYYMSWVRQPPGK ALELLGFIRNKANGYTREYSASVKGRFTMSRDNSQSVLYLQM NTLRAEDSATYYCARDSHRTYFDYWGQGTTLTVSS | (SEQ ID NO: 216) |
| hu182.10.21 b.1a $V_H$ | EVQLVESGGGLVQPGGSLRLSCATSGFTFSDYYMSWVRQAPG KGLELLGFIRNKANGYTREYSASVKGRFTMSRDNSKNSLYLQ MNSLKTEDTAVYYCARDSHRTYFDYWGQGTTVTVSS | (SEQ ID NO: 217) |
| mu182.23.1 $V_H$ | DVQLQESGPGLVKPAQSLSLTCSVTGYSITSGYYWNWNRQFPG IKLEWMGYITYEGTNNYNPSLKNRISITRDTSKNQFFLKLNSVT IEDTATYYCAREALWRAMDYWGQGTSVTVSS | (SEQ ID NO: 218) |
| hu181.23.1 1a $V_H$ | EVQLQESGPGLVKPSGTLSLTCAVTGYSITSGYYWNWNRQFPG KGLEWMGYITYEGTNNYNPSLKNRISISRDKSKNQFSLKLSSVT AADTAVYYCAREALWRAMDYWGQGTTVTVSS | (SEQ ID NO: 219) | and the amino acid sequence of the corresponding $V_L$ sequence is selected from the following sequences (CDR sequences in bold):

| $V_L$ | Sequence (N→C) | Identifier |
| --- | --- | --- |
| mu182.19.1 $V_L$ | DIQMTQTTSSLSASLGDRVTISCSASQGISNYLNWYQQKPDGT VKLLIYYTSRLHSGVPSRFSGSGSGTDFSLTISNLEPEDIATYY CQQYSKLPYTFGGGTKLEVK | (SEQ ID NO: 221) |
| mu182.17.1 $V_L$ | DIVMSQSPSSLAVSAGEKVTMSCKSSQSLLNSRTRKSYLAWY QQKPGQSPKVLIYWASSRESGVPDRFTGSGSGTDFTLTISSVQ PEDLAVYYCKQSYNLYTFGGGTKLEIK | (SEQ ID NO: 222) |
| hu182.19.1 1a $V_L$ | DIQMTQSPSSLSASVGDRVTITCSASQGISNYLNWYQQKPGK AVKLLIYYTSRLHSGVPSRFSGSGSGTDFTLTISSLQPEDFATY YCQQYSKLPYTFGGGTKVEIK | (SEQ ID NO: 223) |
| hu182.17.1 1b $V_L$ | DIVMTQSPDSLAVSLGERATINCKSSQSLLNSRTRKSYLAWY QQKPGQPPKVLIYWASSRESGVPDRFSGSGSGTDFTLTISSLQ AEDVAVYYCKQSYNLYTFGGGTKVEIK | (SEQ ID NO: 224) |
| mu182.10.21 $V_L$ | QIVLSQSPAILSASPGEKVTMTCRASSSVSSMHWYQQKPGSSP KPWIYATSNLASGVPTRFSGSGSGTSYSLTISRVEAEDAATYY CQQWSSNPPMYTFGGGTKLEIK | (SEQ ID NO: 225) |
| hu182.10.21 1a $V_L$ | EIVLTQSPDFQSVTPKEKVTITCRASSSVSSMHWYQQKPDQSP KPWIYATSNLASGVPSRFSGSGSGTDYTLTINSLEAEDAATYY CQQWSSNPPMYTFGGGTKVEIK | (SEQ ID NO: 226) |

-continued

| V_L | Sequence (N→C) | Identifier |
|---|---|---|
| hu182.10.21 2a V_L | DIQLTQSPSFLSASVGDRVTITCRASSSVSSMHWYQQKPGKSP KPWIYATSNLASGVPSRFSGSGSGTEYTLTISSLQPEDFATYYC QQWSSNPPMYTFGGGTKVEIK | (SEQ ID NO: 227) |
| mu182.23.1 V_L | ENVLTQSPAIMSASPGEKVTMTCSASSSVSYMHWYQQKSGTS PKLWIYDTSKLASGVPGRFSGSGSGNSYSLTISSMEAEDVATY YCFQGSGYPLTFGAGTKLELK | (SEQ ID NO: 228) |
| hu181.23.1 1a V_L | DNQLTQSPSFLSASVGDRVTITCSASSSVSYMHWYQQKPGKS PKLWIYDTSKLASGVPSRFSGSGSGTEYSLTISSLQPEDFATYY CFQGSGYPLTFGQGTKLEIK | (SEQ ID NO: 229) |
| hu181.23.1 1b V_L | DNQLTQSPSFLSASVGDRVTITCSASSSVSYMHWYQQKPGKA PKLWIYDTSKLASGVPSRFSGSGSGTEYTLTISSLQPEDFATYY CFQGSGYPLTFGQGTKLEIK | (SEQ ID NO: 230) |

In some embodiments, the bispecific binding protein has a B7-H4 binding domain comprising a $V_H$ according to SEQ ID NO:211 and a $V_L$ according to SEQ ID NO:221. In some embodiments, the bispecific binding protein has a B7-H4 binding domain comprising a $V_H$ according to SEQ ID NO:212 and a $V_L$ according to SEQ ID NO:222. In some embodiments, the bispecific binding protein has a B7-H4 binding domain comprising a $V_H$ according to SEQ ID NO:216 and a $V_L$ according to SEQ ID NO:225. In some embodiments, the bispecific binding protein has a B7-H4 binding domain comprising a $V_H$ according to SEQ ID NO:218 and a $V_L$ according to SEQ ID NO:228.

In some embodiments, the bispecific binding protein has a B7-H4 binding domain comprising a $V_H$ according to SEQ ID NO:213, 214, 215, 217, or 219, and a $V_L$ according to SEQ ID NO:223, 224, 226, 227, 229, or 230. In some embodiments, the bispecific binding protein has a B7-H4 binding domain comprising a $V_H$ according to SEQ ID NO:213 and a $V_L$ according to SEQ ID NO:223. In some embodiments, the bispecific binding protein has a B7-H4 binding domain comprising a $V_H$ according to SEQ ID NO:214 and a $V_L$ according to SEQ ID NO:224. In some embodiments, the bispecific binding protein has a B7-H4 binding domain comprising a $V_H$ according to SEQ ID NO:215 and a $V_L$ according to SEQ ID NO:223. In some embodiments, the bispecific binding protein has a B7-H4 binding domain comprising a $V_H$ according to SEQ ID NO:217 and a $V_L$ according to SEQ ID NO:226. In some embodiments, the bispecific binding protein has a B7-H4 binding domain comprising a $V_H$ according to SEQ ID NO:217 and a $V_L$ according to SEQ ID NO:227. In some embodiments, the bispecific binding protein has a B7-H4 binding domain comprising a $V_H$ according to SEQ ID NO:219 and a $V_L$ according to SEQ ID NO:229. In some embodiments, the bispecific binding protein has a B7-H4 binding domain comprising a $V_H$ according to SEQ ID NO:219 and a $V_L$ according to SEQ ID NO:230.

Certain mutations of a $V_H$ or $V_L$ sequence in a tumor antigen binding region described in Section 7.3.3 herein would be understood by a person of skill to afford bispecific binding proteins within the scope of the disclosure. Mutations may include amino acid substitutions, additions, or deletions from a $V_H$ or $V_L$ sequence as disclosed herein while retaining significant activity toward a tumor antigen. Accordingly, in some embodiments, a bispecific binding protein comprises a $V_H$ sequence having at least 85%, at least 90%, at least 93%, at least 95%, at least 96%, at least 97%, at least 98%, or at least 99% sequence identity to any one of the $V_H$ sequences shown in Section 7.3.3. A bispecific binding protein can comprise a $V_H$ sequence having up to 8, up to 7, up to 6, up to 5, up to 4, up to 3, or up to 2 mutations compared with any one of the $V_H$ sequences shown in Section 7.3.3. In some embodiments, a bispecific binding protein can comprise a $V_H$ sequence having 5 or fewer, 4 or fewer, 3 or fewer, or 2 or fewer mutations compared with any one of the $V_H$ sequences shown in Section 7.3.3. In some embodiments, a bispecific binding protein comprises a $V_L$ sequence having at least 85%, at least 90%, at least 93%, at least 95%, at least 96%, at least 97%, at least 98%, or at least 99% sequence identity to any one of the $V_L$ sequences shown in Section 7.3.3. A bispecific binding protein can comprise a $V_L$ sequence having up to 8, up to 7, up to 6, up to 5, up to 4, up to 3, or up to 2 mutations compared with any one of the $V_L$ sequences shown in Section 7.3.3. In some embodiments, a bispecific binding protein can comprise a $V_L$ sequence having 5 or fewer, 4 or fewer, 3 or fewer, or 2 or fewer mutations compared with any one of the $V_L$ sequences shown in Section 7.3.3.

Additional post-translational modifications of a bispecific binding protein may include glycosylation. Common biantennary complexes can be composed of a core structure having two N-acetylglucosamine (GlcNAc), three mannose, and two GlcNAc residues that are β-1,2 linked to α-6 mannose and α-3 mannose to form two antennae. One or more fucose (Fuc), galactose (Gal), high mannose glycans Man-5 or Man-9, bisecting GlcNAc, and sialic acid including N-acetylneuraminic acid (NANA) or N-glycolylneuraminic acid (NGNA) residues may be attached to the core. N-linked glycoforms may include G0 (protein having a core biantennary glycosylation structure), G0F (fucosylated G0), G0F GlcNAc, G1 (protein having a core glycosylation structure with one galactose residue), G1F (fucosylated G1), G2 (protein having a core glycosylation structure with two galactose residues), and/or G2F (fucosylated G2).

7.4. Nucleic Acids and Expression Systems

The present disclosure encompasses nucleic acid molecules encoding immunoglobulin light and heavy chain genes for bispecific binding proteins, polypeptide fragment or component thereof, vectors comprising such nucleic acids, and host cells capable of producing the bispecific binding proteins of the disclosure.

A bispecific binding protein of the disclosure can be prepared by recombinant expression of immunoglobulin light and heavy chain genes in a host cell. To express a binding protein recombinantly, a host cell is transfected with one or more recombinant expression vectors carrying DNA fragments encoding the immunoglobulin light and/or heavy chains of the binding protein such that the light and/or heavy chains are expressed in the host cell and, optionally, secreted into the medium in which the host cells are cultured, from which medium the binding proteins can be recovered. Standard recombinant DNA methodologies are used to obtain binding protein heavy and/or light chain genes, incorporate these genes into recombinant expression vectors and introduce the vectors into host cells, such as those described in Molecular Cloning; A Laboratory Manual, Second Edition (Sambrook, Fritsch and Maniatis (eds), Cold Spring Harbor, N. Y., 1989), Current Protocols in Molecular Biology (Ausubel, F. M. et al., eds., Greene Publishing Associates, 1989) and in U.S. Pat. No. 4,816,397.

To generate nucleic acids encoding such bispecific binding proteins, DNA fragments encoding the light and heavy chain variable regions are first obtained. These DNAs can be obtained by amplification and modification of germline DNA or cDNA encoding light and heavy chain variable sequences, for example using the polymerase chain reaction (PCR). Germline DNA sequences for human heavy and light chain variable region genes are known in the art (See, e.g., the "VBASE" human germline sequence database; see also Kabat, E. A. et al., 1991, Sequences of Proteins of Immunological Interest, Fifth Edition, U.S. Department of Health and Human Services, NIH Publication No. 91-3242; Tomlinson et al., 1992, J. Mol. Biol. 22T:116-198; and Cox et al., 1994, Eur. J. Immunol. 24:827-836; the contents of each of which are incorporated herein by reference).

Once DNA fragments encoding bispecific binding protein-related $V_H$ and $V_L$ segments are obtained, these DNA fragments can be further manipulated by standard recombinant DNA techniques, for example to convert the variable region genes to full-length binding protein chain genes, to Fab fragment genes or to a scFv gene. In these manipulations, a $V_L$- or $V_H$-encoding DNA fragment is operatively linked to another DNA fragment encoding another protein, such as a binding protein constant region or a flexible linker. The term "operatively linked," as used in this context, is intended to mean that the two DNA fragments are joined such that the amino acid sequences encoded by the two DNA fragments remain in-frame.

The isolated DNA encoding the $V_H$ region can be converted to a full-length heavy chain gene by operatively linking the $V_H$-encoding DNA to another DNA molecule encoding heavy chain constant regions (CH1, CH2, CH3 and, optionally, CH4). The sequences of human heavy chain constant region genes are known in the art (See, e.g., Kabat, E. A., et al., 1991, Sequences of Proteins of Immunological Interest, Fifth Edition, U.S. Department of Health and Human Services, NIH Publication No. 91-3242) and DNA fragments encompassing these regions can be obtained by standard PCR amplification. The heavy chain constant region can be an $IgG_1$, $IgG_2$, $IgG_3$, $IgG_4$, IgA, IgE, IgM or IgD constant region, but in certain embodiments is an $IgG_1$, $IgG_2$, or $IgG_4$ constant region. For a Fab fragment heavy chain gene, the $V_H$-encoding DNA can be operatively linked to another DNA molecule encoding only the heavy chain CH1 constant region.

The isolated DNA encoding the $V_L$ region can be converted to a full-length light chain gene (as well as a Fab light chain gene) by operatively linking the $V_L$-encoding DNA to another DNA molecule encoding the light chain constant region, CL. The sequences of human light chain constant region genes are known in the art (See, e.g., Kabat, et al., 1991, Sequences of Proteins of Immunological Interest, Fifth Edition, U.S. Department of Health and Human Services, NIH Publication No. 91-3242) and DNA fragments encompassing these regions can be obtained by standard PCR amplification. The light chain constant region can be a kappa or lambda constant region, but in certain embodiments is a kappa constant region. To create a scFv gene, the $V_H$- and $V_L$-encoding DNA fragments are operatively linked to another fragment encoding a flexible linker, e.g., encoding the amino acid sequence $(Gly_4\text{~}Ser)_3$ (SEQ ID NO:301), such that the $V_H$ and $V_L$ sequences can be expressed as a contiguous single-chain protein, with the $V_L$ and $V_H$ regions joined by the flexible linker (See, e.g., Bird et al., 1988, Science 242:423-426; Huston et al., 1988, Proc. Natl. Acad. Sci. USA 85:5879-5883; McCafferty et al., 1990, Nature 348:552-554).

To express the bispecific binding protein of the disclosure, DNAs encoding partial or full-length light and heavy chains, obtained as described above, are inserted into expression vectors such that the genes are operatively linked to transcriptional and translational control sequences. In this context, the term "operatively linked" is intended to mean that a binding protein gene is ligated into a vector such that transcriptional and translational control sequences within the vector serve their intended function of regulating the transcription and translation of the binding protein gene. The expression vector and expression control sequences are chosen to be compatible with the expression host cell used. The binding protein light chain gene, if present, and the binding protein heavy chain gene can be inserted into separate vectors or, more typically, both genes are inserted into the same expression vector.

The bispecific binding protein genes are inserted into the expression vector by standard methods (e.g., ligation of complementary restriction sites on the binding protein gene fragment and vector, or blunt end ligation if no restriction sites are present). Prior to insertion of the bispecific binding protein-related light or heavy chain sequences, the expression vector can already carry binding protein constant region sequences. For example, one approach to converting the bispecific binding protein-related $V_H$ and $V_L$ sequences to full-length binding protein genes is to insert them into expression vectors already encoding heavy chain constant and light chain constant regions, respectively, such that the $V_H$ segment is operatively linked to the CH segment(s) within the vector and the $V_L$ segment is operatively linked to the CL segment within the vector. Additionally or alternatively, the recombinant expression vector can encode a signal peptide that facilitates secretion of the binding protein chain from a host cell. The binding protein chain gene can be cloned into the vector such that the signal peptide is linked in-frame to the amino terminus of the binding protein chain gene. The signal peptide can be an immunoglobulin signal peptide or a heterologous signal peptide (i.e., a signal peptide from a non-immunoglobulin protein).

In addition to the binding protein chain genes, the recombinant expression vectors of the disclosure carry regulatory sequences that control the expression of the binding protein chain genes in a host cell. The term "regulatory sequence" is intended to include promoters, enhancers and other expression control elements (e.g., polyadenylation signals) that control the transcription or translation of the binding protein chain genes. Such regulatory sequences are described, for example, in Goeddel, Gene Expression Technology: Methods in Enzymology 185, Academic Press, San Diego, Calif., 1990. It will be appreciated by those skilled in the art that the design of the expression vector, including the selection of regulatory sequences may depend on such factors as the choice of the host cell to be transformed, the level of expression of protein desired, etc. Suitable regulatory sequences for mammalian host cell expression include viral elements that direct high levels of protein expression in mammalian cells, such as promoters and/or enhancers derived from cytomegalovirus (CMV) (such as the CMV promoter/enhancer), Simian Virus 40 (SV40) (such as the SV40 promoter/enhancer), adenovirus, (e.g., the adenovirus major late promoter (AdMLP)) and polyoma. For further description of viral regulatory elements, and sequences thereof, see, e.g., U.S. Pat. No. 5,168,062 by Stinski, U.S. Pat. No. 4,510,245 by Bell et al., and U.S. Pat. No. 4,968,615 by Schaffner et al.

In addition to the bispecific binding protein chain genes and regulatory sequences, the recombinant expression vectors of the disclosure can carry additional sequences, such as sequences that regulate replication of the vector in host cells (e.g., origins of replication) and selectable marker genes. The selectable marker gene facilitates selection of host cells into which the vector has been introduced (See, e.g., U.S. Pat. Nos. 4,399,216, 4,634,665 and 5,179,017, all by Axel et al.). For example, typically the selectable marker gene confers resistance to drugs, such as G418, hygromycin or methotrexate, on a host cell into which the vector has been introduced. Suitable selectable marker genes include the dihydrofolate reductase (DHFR) gene (for use in DHFR$^-$ host cells with methotrexate selection/amplification) and the neo gene (for G418 selection). For expression of the light and heavy chains, the expression vector(s) encoding the heavy and light chains is transfected into a host cell by standard techniques. The various forms of the term "transfection" are intended to encompass a wide variety of techniques commonly used for the introduction of exogenous DNA into a prokaryotic or eukaryotic host cell, e.g., electroporation, lipofection, calcium-phosphate precipitation, DEAE-dextran transfection and the like.

It is possible to express the bispecific binding proteins of the disclosure in either prokaryotic or eukaryotic host cells. In certain embodiments, expression of binding proteins is performed in eukaryotic cells, e.g., mammalian host cells, of optimal secretion of a properly folded and immunologically active binding protein. Exemplary mammalian host cells for expressing the recombinant binding proteins of the disclosure include Chinese Hamster Ovary (CHO cells) (including DHFR$^-$ CHO cells, described in Urlaub and Chasin, 1980, Proc. Natl. Acad. Sci. USA 77:4216-4220, used with a DHFR selectable marker, e.g., as described in Kaufman and Sharp, 1982, Mol. Biol. 159:601-621), NSO myeloma cells, COS cells and SP2 cells. When recombinant expression vectors encoding binding protein genes are introduced into mammalian host cells, the bispecific binding proteins are produced by culturing the host cells for a period of time sufficient to allow for expression of the bispecific binding protein in the host cells or secretion of the binding protein into the culture medium in which the host cells are grown. Binding proteins can be recovered from the culture medium using standard protein purification methods. Host cells can also be used to produce portions of intact binding proteins, such as Fab fragments or scFv molecules. It is understood that variations on the above procedure are within the scope of the present disclosure. For example, it can be desirable to transfect a host cell with DNA encoding either the light chain or the heavy chain (but not both) of a bispecific binding protein of this disclosure.

Recombinant DNA technology can also be used to remove some or all of the DNA encoding either or both of the light and heavy chains that is not necessary for binding to the immunomodulatory protein and/or the tumor antigen. The molecules expressed from such truncated DNA molecules are also encompassed by the binding proteins of the disclosure.

For recombinant expression of a bispecific binding protein of the disclosure, the host cell can be co-transfected with two expression vectors of the disclosure, the first vector encoding a heavy chain derived polypeptide and the second vector encoding a light chain derived polypeptide. The two vectors can contain identical selectable markers, or they can each contain a separate selectable marker. Alternatively, a single vector can be used which encodes both heavy and light chain polypeptides.

Once a nucleic acid encoding one or more portions of a bispecific binding protein, further alterations or mutations can be introduced into the coding sequence, for example to generate nucleic acids encoding binding proteins with different CDR sequences, binding proteins with reduced affinity to the Fc receptor, or binding proteins of different subclasses.

The bispecific binding proteins of the disclosure can also be produced by chemical synthesis (e.g., by the methods described in Solid Phase Peptide Synthesis, $2^{nd}$ ed., 1984 The Pierce Chemical Co., Rockford, Ill.). Variant binding proteins can also be generated using a cell-free platform (See, e.g., Chu et al., Biochemia No. 2, 2001 (Roche Molecular Biologicals) and Murray et al., 2013, Current Opinion in Chemical Biology, 17:420-426).

7.5. Purification of Bispecific Binding Proteins

Once a polypeptide of the disclosure has been produced by recombinant expression, it can be purified by any method known in the art for purification of a protein, for example, by chromatography (e.g., ion exchange, affinity, particularly by affinity for antigen after Protein A or Protein G selection, and sizing column chromatography), centrifugation, differential solubility, or by any other standard technique for the purification of proteins, or any combination of techniques thereof. Further, the polypeptides of the present disclosure or fragments thereof can be fused to heterologous polypeptide sequences described herein or otherwise known in the art to facilitate purification. The polypeptides may be purified as a monomer or as a dimer, e.g., as a bispecific binding protein comprising two polypeptides. For example, a polypeptide may be purified by a series of steps comprising clarification, Protein A chromatography, and viral inactivation.

Once isolated, a bispecific binding protein can, if desired, be further purified, e.g., by high performance liquid chromatography (See, e.g., Fisher, *Laboratory Techniques In Biochemistry And Molecular Biology* (Work and Burdon, eds., Elsevier, 1980)), size-exclusion chromatography, hydrophobic interaction chromatography (e.g., with an aliphatic cross-linked agarose medium such as Butyl Sepharose High Performance (GE Healthcare Life Sciences)), hydroxyapatite chromatography (e.g., using a CaPure-HA (Tosoh Bioscience LLC) or CHT Ceramic Hydroxyapatite Type I (Bio-Rad Laboratories, Inc.) support) or gel filtration chromatography (e.g., using a Superdex™ 75 column (Pharmacia Biotech AB, Uppsala, Sweden)). A variety of chromatographic techniques known in the art, for example, flow through or bind-and-elute mode, gradient elution, can be used to purify the preparation of the bispecific binding protein. In a specific embodiment, a bispecific binding protein that binds CD40 and mesothelin is purified by hydroxyapatite chromatography, wherein the pH is maintained at 6.7±0.1.

A bispecific binding protein of the disclosure may also be purified through one or more filtrations, for example, comprising activated carbon filtration, membrane filtration (e.g., sterile filtration through a porous hydrophilic polymer such as polyethersulfone, Q membrane filtration, or S membrane filtration). For instance, activated carbon filtration uses the large surface area or pore sizes within activated carbon to adsorb impurities from the flow stream. Q membrane filtration uses an anion exchange membrane bearing quaternary ammonium ions on its surface in order to retain highly negatively charged species. In contrast, S membrane filtration uses a cation exchange membrane bearing sulfate ions to retain highly positively charged impurities.

Standard final finishing techniques such as nanofiltration and diafiltration, or any combination in series of any final finishing techniques, may be used for additional purification to afford a purified bispecific binding protein.

7.6. Pharmaceutical Compositions

The bispecific binding proteins described herein may be in the form of compositions comprising the protein and one or more carriers, excipients and/or diluents. The compositions may be formulated for specific uses, such as for veterinary uses or pharmaceutical uses in humans. The form of the composition (e.g., dry powder, liquid formulation, etc.) and the excipients, diluents and/or carriers used will depend upon the intended uses of the binding protein and, for therapeutic uses, the mode of administration.

For therapeutic uses, the compositions may be supplied as part of a sterile, pharmaceutical composition that includes a pharmaceutically acceptable carrier. This composition can be in any suitable form (depending upon the desired method of administering it to a subject, e.g., a human subject, i.e., patient). The pharmaceutical composition can be administered to a subject by a variety of routes such as orally, transdermally, subcutaneously, intranasally, intravenously, intramuscularly, intratumorally, intrathecally, topically or locally. The most suitable route for administration in any given case will depend on the particular bispecific binding protein, the subject, and the nature and severity of the disease and the physical condition of the subject. Typically, the pharmaceutical composition will be administered intravenously or subcutaneously.

Pharmaceutical compositions can be conveniently presented in unit dosage forms containing a predetermined amount of a bispecific binding protein described herein per dose. The quantity of binding protein included in a unit dose will depend on the disease being treated, as well as other factors as are well known in the art. Such unit dosages may be in the form of a lyophilized dry powder containing an amount of binding protein suitable for a single administration, or in the form of a liquid. Dry powder unit dosage forms may be packaged in a kit with a syringe, a suitable quantity of diluent and/or other components useful for administration. Unit dosages in liquid form may be conveniently supplied in the form of a syringe pre-filled with a quantity of binding protein suitable for a single administration.

The pharmaceutical compositions may also be supplied in bulk form containing quantities of bispecific binding protein suitable for multiple administrations.

Pharmaceutical compositions may be prepared for storage as lyophilized formulations or aqueous solutions by mixing a bispecific binding protein having the desired degree of purity with optional pharmaceutically-acceptable carriers, excipients or stabilizers typically employed in the art (all of which are referred to herein as "carriers"), i.e., buffering agents, stabilizing agents, preservatives, isotonifiers, non-ionic detergents, antioxidants, and other miscellaneous additives. See, Remington's Pharmaceutical Sciences, 16th edition (Osol, ed. 1980). Such additives should be nontoxic to the recipients at the dosages and concentrations employed.

7.7. Methods of Use

7.7.1. Therapeutic Benefit

As discussed previously, for a variety of solid tumors, one or more tumor antigens are expressed on the surface of the tumor cell, but not expressed or minimally expressed on the surface of non-cancerous cells. Data provided herein demonstrate that bispecific binding proteins described herein that agonize an immunomodulatory protein and bind a cell-surface tumor antigen exert potent anti-tumor activity against these solid tumors in vivo. Accordingly, the bispecific binding proteins and/or pharmaceutical compositions comprising the bispecific binding proteins may be used therapeutically to treat solid tumors.

Generally, the methods involve administering to a human patient having a solid tumor an effective amount of a bispecific binding protein that agonizes an immunomodulatory protein and binds a cell-surface tumor antigen to provide therapeutic benefit. Solid tumors that may be treated with the binding proteins include, but are not limited to, adrenal cancer, bladder cancer, bone cancer, brain cancer (e.g., glioma), breast cancer, cervical cancer, colorectal cancer, endometrial cancer, esophageal cancer, eye cancer, gastric cancer, head and neck cancer, kidney cancer, liver cancer, lung cancer (e.g., non-small cell lung cancer such as non-squamous non-small cell lung cancer, lung adenocarcinoma, mesothelioma), lymphoma (e.g., B cell lymphoma), melanoma (e.g., advanced malignant melanoma), oral cancer, ovarian cancer (e.g., platinum-resistant ovarian cancer, fallopian tube cancer, primary peritoneal cancer), pancreatic cancer, penile cancer, prostate cancer, skin cancer, testicular cancer, thyroid cancer, uterine cancer, and vaginal cancer. In some embodiments, the solid tumor is selected from brain cancer, breast cancer, gastric cancer, lung cancer, melanoma, ovarian cancer, pancreatic cancer and prostate cancer. The cancers may be comprised of tumor cells that express a tumor antigen, cancers comprised of tumor cells that do not express a tumor antigen, or cancers comprised of tumor cells, some of which express a tumor antigen and some of which do not. In some embodiments, the solid tumor is an advanced solid tumor that has progressed on a standard therapy known to provide clinical benefit (e.g., a platinum-based therapy) or the patient cannot otherwise be treated with a standard therapy (e.g., the patient is allergic to an active ingredient in a standard therapy). In certain embodiments, a bispecific protein binding mesothelin is used to treat mesothelin-positive advanced solid tumors that have progressed on standard therapy known to provide clinical benefit or in a patient who cannot otherwise be treated with a standard therapy. In certain embodiments, a bispecific protein binding mesothelin is used to treat lung adenocarcinoma, mesothelioma, pancreatic cancer or ovarian cancer. In certain embodiments, a bispecific protein binding mesothelin is used to treat non-squamous non-small cell lung cancer, mesothelioma, pancreatic cancer or ovarian cancer. In certain embodiments, a bispecific protein binding mesothelin is used to treat ovarian cancer with locally advanced or metastatic disease that has progressed on standard therapy known to provide clinical benefit or in a patient who cannot otherwise be treated with a standard therapy. In certain embodiments, a bispecific protein binding mesothelin is used to treat non-small cell lung cancer with locally advanced or metastatic disease that has progressed on standard therapy known to provide clinical benefit or in a patient who cannot otherwise be treated with a standard therapy. In certain embodiments, a bispecific protein binding mesothelin is used to treat non-squamous non-small cell lung cancer with locally advanced or metastatic disease that has progressed after receiving a platinum-based therapy (or an epidermal growth factor receptor (EGFR) inhibitor, a tyrosine kinase (TK) inhibitor, or an anaplastic lymphoma kinase (ALK) inhibitor for tumors containing EGFR-activating or TK-activating mutations, or ALK rearrangement, respectively). In certain embodiments, a bispecific protein binding mesothelin is used to treat non-squamous non-small cell lung cancer with locally advanced or metastatic disease that has progressed after receiving immunotherapy, such as an anti-PD-1 or anti-PD-L1 antagonist monoclonal antibody as a single agent, in combination with chemotherapy, or in combination with an anti-CTLA-4 antagonist antibody. In certain embodiments, a bispecific protein binding EGFR is used to treat colorectal cancer, head and neck cancer, non-small cell lung cancer, or glioblastoma. In certain embodiments, a bispecific protein binding PSMA is used to treat prostate cancer. In certain embodiments, a bispecific protein binding B7-H4 is used to treat breast cancer or ovarian cancer.

Figure 19:
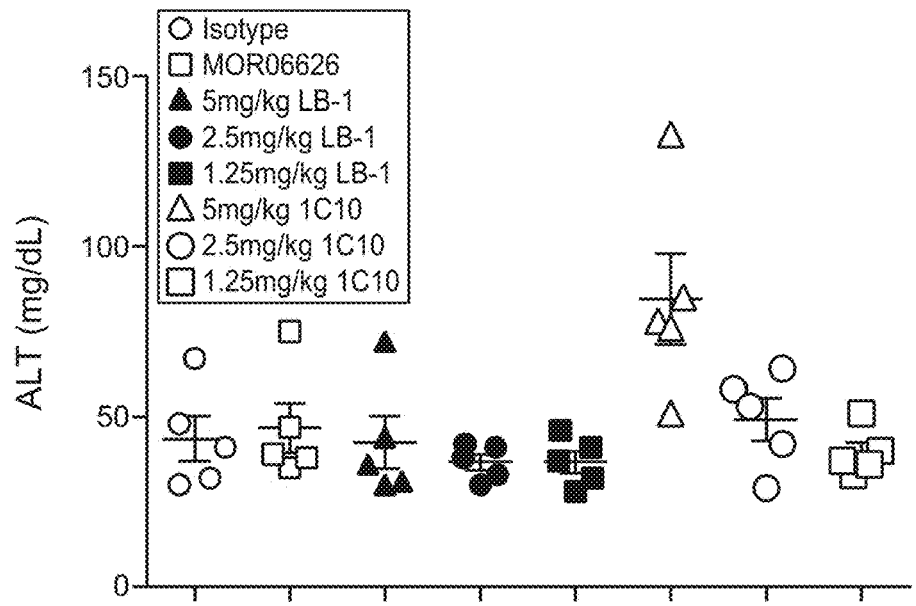
FIG. 19 depicts effects of dosing anti-CD40 antibody 1C10, anti-mesothelin antibody MOR06626, or bispecific binding protein LB-1 on liver enzyme ALT levels in mg/dL in mice carrying 4T1 syngeneic tumors expressing mesothelin.
Figure 20:
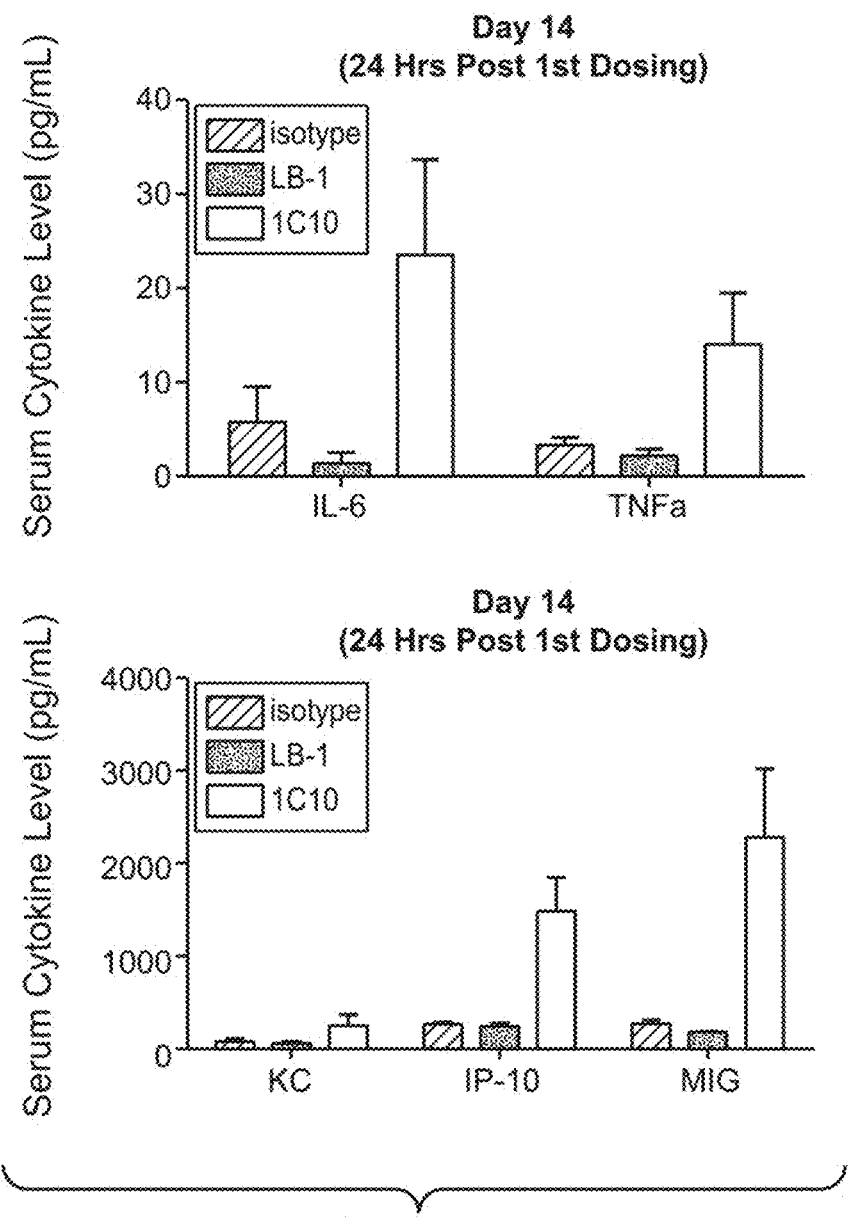
FIG. 20 depicts effects on cytokine levels interleukin-6 ("IL-6"), tumor necrosis factor-alpha ("TNFa"), keratinocyte chemoattractant ("KC"), interferon gamma-induced protein 10 ("IP-10") and monokine induced by interferon-gamma ("MIG") in mice after dosing with 5 mg/kg of anti-CD40 antibody 1C10 mIgG1 ("1C10"), mouse IgG1 ("isotype"), and bispecific binding protein LB-1 ("LB-1").

The cancer may be newly diagnosed and naïve to treatment, or may be resistant, relapsed, refractory, or relapsed and refractory, or a metastatic form of a solid tumor. In vivo data in mouse xenograft models (FIGS. 17A-17B) as well as in a murine syngeneic tumor model (FIG. 18) show that the bispecific binding proteins exhibit a significant antitumor effect. Additionally, biochemical biomarkers in FIGS. 19 and 20 show a reduced liver toxicity and lower cytokine release on administration of a bispecific binding protein as compared to the same dose of known murine antibody 1C10.

As discussed above, the presently disclosed bispecific binding proteins activate an immunological response. Accordingly, patients having altered immune systems may be excluded from treatment. In some embodiments, a patient is excluded after meeting one or more of the following criteria: (1) Active or prior documented autoimmune disease (including, but not limited to, inflammatory bowel disease, celiac disease, Wegener syndrome) within the past 2 years. (Subjects with childhood atopy or asthma, vitiligo, alopecia, Hashimoto syndrome, Grave's disease, or psoriasis not requiring systemic treatment (within the past 2 years) are not excluded); (2) History of primary immunodeficiency, bone marrow transplantation, chronic lymphocytic leukemia, solid organ transplantation, or previous clinical diagnosis of tuberculosis; (3) History of a coagulopathy or a platelet disorder; (4) Confirmed positive test results for human immunodeficiency virus (HIV), or subjects with chronic or active hepatitis B or C. (Subjects who have a history of hepatitis B or C who have documented cures after anti-viral therapy may be enrolled); (5) Prior grade ≥3 immune-mediated neurotoxicity or pneumonitis while receiving immunotherapy (including but not limited to agents directed against CTLA-4, PD-L1, or PD-1), or any other prior grade ≥3 immune-mediated adverse event while receiving immunotherapy that has not resolved or become asymptomatic within 3 months; (6) Receipt of live, attenuated vaccine within 28 days prior to the first dose of the bispecific binding protein.

A bispecific binding protein of the disclosure may be administered alone (monotherapy) or adjunctive to, or with, other anti-cancer therapies and/or targeted or non-targeted anti-cancer agents. When administered as bispecific binding protein monotherapy, one or more bispecific binding proteins may be used. Whether administered as monotherapy or adjunctive to, or with, other therapies or agents, an amount of bispecific binding protein is administered such that the overall treatment regimen provides therapeutic benefit.

By therapeutic benefit is meant that the use of a bispecific binding protein to treat cancer in a patient results in any demonstrated clinical benefit compared with no therapy (when appropriate) or to a known standard of care. Clinical benefit can be assessed by any method known to one of ordinary skill in the art. In one embodiment, clinical benefit is assessed based on objective response rate (ORR) (determined using RECIST version 1.1), duration of response (DOR), progression-free survival (PFS), and/or overall survival (OS). In some embodiments, a complete response indicates therapeutic benefit. In some embodiments, a partial response indicates therapeutic benefit. In some embodiments, stable disease indicates therapeutic benefit. In some embodiments, an increase in overall survival indicates therapeutic benefit. In some embodiments, therapeutic benefit may constitute an improvement in time to disease progression and/or an improvement in symptoms or quality of life. In other embodiments, therapeutic benefit may not translate to an increased period of disease control, but rather a markedly reduced symptom burden resulting in improved quality of life. As will be apparent to those of skill in the art, a therapeutic benefit may be observed using the bispecific binding proteins alone (monotherapy) or adjunctive to, or with, other anti-cancer therapies and/or targeted or non-targeted anti-cancer agents.

Typically, therapeutic benefit is assessed using standard clinical tests designed to measure the response to a new treatment for cancer. To assess the therapeutic benefits of the bispecific binding proteins described herein one or a combination of the following tests can be used: (1) the Response Evaluation Criteria In Solid Tumors (RECIST) version 1.1, (2) immune-related RECIST (irRECIST), (3) the Eastern Cooperative Oncology Group (ECOG) Performance Status, (4) immune-related response criteria (irRC), (5) disease evaluable by assessment of tumor antigens, (6) validated patient reported outcome scales, and/or (7) Kaplan-Meier estimates for overall survival and progression free survival.

Assessment of the change in tumor burden is an important feature of the clinical evaluation of cancer therapeutics. Both tumor shrinkage (objective response) and time to the development of disease progression are important endpoints in cancer clinical trials. Standardized response criteria, known as RECIST (Response Evaluation Criteria in Solid Tumors), were published in 2000. An update (RECIST 1.1) was released in 2009. RECIST criteria are typically used in clinical trials where objective response is the primary study endpoint, as well as in trials where assessment of stable disease, tumor progression or time to progression analyses are undertaken because these outcome measures are based on an assessment of anatomical tumor burden and its change over the course of the trial. TABLE 3 provides the definitions of the response criteria used to determine objective tumor response to a study drug, such as the bispecific binding proteins described herein.

TABLE 3

| Response | Criteria |
|---|---|
| Complete Response (CR) | Disappearance of all target lesions. Any pathological lymph nodes (whether target or non-target) must have reduction in short axis to <10 mm. |
| Partial Response (PR) | At least a 30% decrease in the sum of diameters of target lesions, taking as reference the baseline sum diameters. |

TABLE 3-continued

| Response | Criteria |
| --- | --- |
| Progressive Disease (PD) | At least a 20% increase in the sum of diameters of target lesions, taking as reference the smallest sum on study (this includes the baseline sum if that is the smallest on study). In addition to the relative increase of 20%, the sum must also demonstrate an absolute increase of at least 5 mm. (Note: the appearance of one or more new lesions is also considered progression). |
| Stable Disease (SD) | Neither sufficient shrinkage to qualify for PR nor sufficient increase to qualify for PD, taking as reference the smallest sum diameters while on study. |

Secondary outcome measures that can be used to determine the therapeutic benefit of the bispecific binding proteins described herein include, Objective Response Rate (ORR), Progression Free Survival (PFS), Overall Survival (OS), Duration of Overall Response (DOR), and Depth of Response (DpR). ORR is defined as the proportion of the participants who achieve a complete response (CR) or partial response (PR). PFS is defined as the time from the first dose date of a bispecific binding protein to either disease progression or death, whichever occurs first. OS is defined as the length of time from either the date of diagnosis or the start of treatment for a disease, such as cancer, that patients diagnosed with the disease are still alive. DOR is defined as the time from the participant's initial CR or PR to the time of disease progression. DpR is defined as the percentage of tumor shrinkage observed at the maximal response point compared to baseline tumor load. Clinical endpoints for both ORR and PFS can be determined based on RECIST 1.1 criteria described above.

Additional criteria that may be used for clinical evaluation specific to cancer patients undergoing immune therapy treatment include the standardized immune-related RECIST (ir-RECIST) criteria. See, e.g., Nishino, M. et al. *Eur. J. Radiol.*, 84(7), pages 1259-1268 (2015 July). These guidelines modified the RECIST 1.1 criteria above with consideration of potential immunomodulatory effects. TABLE 4 provides the definitions of the response criteria used to determine objective tumor response to an immunomodulatory drug, such as the bispecific binding proteins described herein.

TABLE 4

| Response | Criteria |
| --- | --- |
| Complete Response (irCR) | Complete disappearance of all measurable and non-measurable lesions. Lymph nodes must decrease to <10 mm in short axis. |
| Partial Response (irPR) | Decrease of ≥30% in total measured tumor burden relative to baseline, non-target lesions are irNN, and no unequivocal progression of new non-measurable lesions |
| Progressive Disease (irPD) | At least a 20% increase and at least 5 mm absolute increase in TMTB compared to nadir, or irPD for non-target or new non-measurable lesions. Confirmation of progression is recommended at least 4 weeks after the first irPD assessment. |
| Non-irCR or non-irPD (irNN) | No target disease was identified at baseline and at follow-up the patient fails to meet criteria for irCR or irPD |
| Stable Disease (irSD) | Neither sufficient shrinkage to qualify for irPR nor sufficient increase to qualify for irPD, taking as reference the smallest sum diameters while on study. |
| irNE | Used in exceptional cases where insufficient data exists. |

The ECOG Scale of Performance Status shown in TABLE 5 is used to describe a patient's level of functioning in terms of their ability to care for themselves, daily activity, and physical ability. The scale was developed by the Eastern Cooperative Oncology Group (ECOG), now part of the ECOG-ACRIN Cancer Research Group, and published in 1982.

TABLE 5

| Grade | ECOG Performance Status |
| --- | --- |
| 0 | Fully active, able to carry on all pre-disease performance without restriction |
| 1 | Restricted in physically strenuous activity but ambulatory and able to carry out work of a light or sedentary nature, e.g., light house work, office work |
| 2 | Ambulatory and capable of all selfcare but unable to carry out any work activities; up and about more than 50% of waking hours |
| 3 | Capable of only limited selfcare; confined to bed or chair more than 50% of waking hours |
| 4 | Completely disabled; cannot carry on any selfcare; totally confined to bed or chair |
| 5 | Dead |

Another set of criteria that can be used to characterize fully and to determine response to immunotherapeutic agents, such as antibody-based cancer therapies, is the immune-related response criteria (irRC), which was developed for measurement of solid tumors in 2009, and updated in 2013. See, e.g., Wolchok, et al. Clin. Cancer Res. 2009; 15(23): 7412-7420 and Nishino, et al. Clin. Cancer Res. 2013; 19(14): 3936-3943. The updated irRC criteria are typically used to assess the effect of an immunotherapeutic agent, such as a bispecific binding protein described herein, on tumor burden, and defines response according to TABLE 6.

TABLE 6

| Response | Criteria |
| --- | --- |
| Complete Response (CR) | Disappearance of all target lesions in two consecutive observations not less than 4 weeks apart |
| Partial Response (PR) | At least a 30% decrease in the sum of the longest diameters of target lesions, taking as reference the baseline sum diameters. |
| Progressive Disease (PD) | At least a 20% increase in the sum of diameters of target lesions, taking as reference the smallest sum on study (this includes the baseline sum if that is the smallest on study). (Note: the appearance of one or more new lesions is not considered progression. The measurement of new lesions is included in the sum of the measurements). |
| Stable Disease (SD) | Neither sufficient shrinkage to qualify for PR nor sufficient increase to qualify for PD, taking as reference the smallest sum diameters while on study. |

One exemplary therapeutic benefit resulting from the use of bispecific binding proteins described herein to treat solid tumors, whether administered as monotherapy or adjunctive to, or with, other therapies or agents, is a complete response. Another exemplary therapeutic benefit resulting from the use of bispecific binding proteins described herein to treat solid tumors, whether administered as monotherapy or adjunctive to, or with, other therapies or agents, is a partial response.

Validated patient reported outcome scales can also be used to denote response provided by each patient through a specific reporting system. Rather than being disease focused, such outcome scales are concerned with retained function while managing a chronic condition. One non-limiting example of a validated patient reported outcome scale is PROMIS® (Patient Reported Outcomes Measurement Information System) from the United States National Institutes of Health. For example, PROMIS® Physical Function Instrument for adult cancer patients can evaluate self-reported capabilities for the functioning of upper extremities (e.g., dexterity), lower extremities (e.g., walking or mobility), and central regions (e.g., neck, back mobility), and includes routine daily activities, such as running errands.

Kaplan-Meier curves (Kaplan and Meier, J. Am. Stat. Assoc. 1958; 53(282): 457-481) can also be used to estimate overall survival and progression free survival for cancer patients undergoing bispecific binding protein therapy in comparison to standard of care.

7.7.2. Adjunctive Therapies

The bispecific binding proteins may be used adjunctive to, or with, other agents or treatments having anti-cancer properties. When used adjunctively, the bispecific binding protein and other agent(s) may be formulated together in a single, combination pharmaceutical formulation, or may be formulated and administered separately, either on a single coordinated dosing regimen or on different dosing regimens. Agents administered adjunctive to or with the bispecific binding proteins will typically have complementary activities to the bispecific binding proteins such that the binding proteins and other agents do not adversely affect each other.

Agents that may be administered adjunctive to or with a bispecific binding protein include, but are not limited to, alkylating agents, angiogenesis inhibitors, antibodies, antimetabolites, antimitotics, antiproliferatives, antivirals, aurora kinase inhibitors, apoptosis promoters (for example, Bcl-2 family inhibitors), activators of death receptor pathway, Bcr-Abl kinase inhibitors, BiTE (Bi-Specific T cell Engager) antibodies, antibody drug conjugates, biologic response modifiers, cyclin-dependent kinase inhibitors, cell cycle inhibitors, cyclooxygenase-2 inhibitors, DVDs, leukemia viral oncogene homolog (ErbB2) receptor inhibitors, growth factor inhibitors, heat shock protein (HSP)-90 inhibitors, histone deacetylase (HDAC) inhibitors, hormonal therapies, immunologicals, inhibitors of inhibitors of apoptosis proteins (IAPs), intercalating antibiotics, kinase inhibitors, kinesin inhibitors, Jak2 inhibitors, mammalian target of rapamycin (mTor) inhibitors, microRNAs, mitogen-activated extracellular signal-regulated kinase inhibitors, non-steroidal anti-inflammatory drugs (NSAIDs), poly ADP (adenosine diphosphate)-ribose polymerase (PARP) inhibitors, platinum chemotherapeutics, Bruton's tyrosine kinase (BTK) inhibitors (e.g., ibrutinib, acalabrutinib), polo-like kinase (P1k) inhibitors, phosphoinositide-3 kinase (PI3K) inhibitors, proteasome inhibitors, purine analogs, pyrimidine analogs, receptor tyrosine kinase inhibitors, retinoids/deltoids plant alkaloids, small inhibitory ribonucleic acids (siRNAs), topoisomerase inhibitors, ubiquitin ligase inhibitors, as well as combinations of one or more of these agents.

Examples of immunologicals include, but are not limited to, interferons, immune checkpoint inhibitors, and other immune-enhancing agents. Interferons include interferon alpha, interferon alpha-2a, interferon alpha-2b, interferon beta, interferon gamma-1a, ACTIMMUNE® (interferon gamma-1b) or interferon gamma-n1, combinations thereof and the like Immune check point inhibitors include antibodies that target PD-1 (e.g., pembrolizumab and nivolumab), PD-L1 (e.g., durvalumab, atezolizumab, avelumab, MEDI4736, MSB0010718C and MPDL3280A), and CTLA4 (cytotoxic lymphocyte antigen 4; e.g., ipilimumab, tremelimumab) Immune-enhancing agents include anti-OX40 agonist antibodies that activate T cells.

A bispecific binding protein may also be used to enhance the efficacy of radiation therapy. Examples of radiation therapy include external beam radiation therapy, internal radiation therapy (i.e., brachytherapy) and systemic radiation therapy.

7.8. Dosages and Administration Regimens

The amount of bispecific binding protein administered will depend upon a variety of factors, including but not limited to, the particular type of solid tumor treated, the stage of the solid tumor being treated, the mode of administration, the frequency of administration, the desired therapeutic benefit, and other parameters such as the age, weight and other characteristics of the patient, etc. Determination of dosages effective to provide therapeutic benefit for specific modes and frequency of administration is within the capabilities of those skilled in the art.

Dosages effective to provide therapeutic benefit may be estimated initially from in vivo animal models or clinical trials. Suitable animal models for a wide variety of diseases are known in the art.

The bispecific binding proteins disclosed herein may be administered by any route appropriate to the condition to be treated. A bispecific binding protein will typically be administered parenterally, i.e., infusion, subcutaneous, intramuscular, intravenous (IV), intradermal, intrathecal, bolus, intratumor injection or epidural ((Shire et al., 2004, *J. Pharm. Sciences* 93(6):1390-1402)). In one embodiment, a bispecific binding protein is provided as a lyophilized powder in a vial. Prior to administration, the lyophilized powder is reconstituted with sterile water for injection (SWFI) or other suitable medium to provide a solution containing the bispecific binding protein. The resulting reconstituted solution is further diluted with saline or other suitable medium and administered via an IV infusion twice every 7 days, once every 7 days, once every 14 days, once every 21 days, once every 28 days, once every 35 days, once every 42 days, once every 49 days, or once every 56 days. In some embodiments, for the first cycle, the infusion occurs over 90 minutes. In some embodiments, subsequent infusions are over 60 minutes.

In some embodiments, an anti-mesothelin bispecific binding protein that agonizes CD40 comprises two polypeptides, each comprising an amino acid sequence of any one of SEQ ID NOS: 401, 402, 403, 404, 405, 406, 407, 408, 409, 410, 411, 412, 419, 420, and 421.

In one exemplary embodiment, an anti-mesothelin bispecific binding protein that agonizes CD40 is administered once every 28 days at 0.005 mg/kg, 0.01 mg/kg, 0.02 mg/kg, 0.03 mg/kg, 0.04 mg/kg, 0.05 mg/kg, 0.06 mg/kg, 0.08 mg/kg, 0.1 mg/kg, 0.2 mg/kg, 0.3 mg/kg, 0.4 mg/kg, 0.5 mg/kg, 0.6 mg/kg, 0.8 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.2 mg/kg, 2.4 mg/kg, 2.6 mg/kg, 2.8 mg/kg, 3.0 mg/kg, 3.2 mg/kg, 3.4 mg/kg, 3.6 mg/kg, 3.8 mg/kg, 4.0 mg/kg, 4.4 mg/kg, 4.8 mg/kg, or 5.0 mg/kg.

In another exemplary embodiment, an anti-mesothelin bispecific binding protein that agonizes CD40 is administered once every 21 days at 0.005 mg/kg, 0.01 mg/kg, 0.02 mg/kg, 0.03 mg/kg, 0.04 mg/kg, 0.05 mg/kg, 0.06 mg/kg, 0.08 mg/kg, 0.1 mg/kg, 0.2 mg/kg, 0.3 mg/kg, 0.4 mg/kg, 0.5 mg/kg, 0.6 mg/kg, 0.8 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.2 mg/kg, 2.4 mg/kg, 2.6 mg/kg, 2.8 mg/kg, 3.0 mg/kg, 3.2 mg/kg, 3.4 mg/kg, 3.6 mg/kg, 3.8 mg/kg, 4.0 mg/kg, 4.4 mg/kg, 4.8 mg/kg, or 5.0 mg/kg.

In yet another exemplary embodiment, an anti-mesothelin bispecific binding protein that agonizes CD40 is administered once every 14 days at 0.005 mg/kg, 0.01 mg/kg, 0.02 mg/kg, 0.03 mg/kg, 0.04 mg/kg, 0.05 mg/kg, 0.06 mg/kg, 0.08 mg/kg, 0.1 mg/kg, 0.2 mg/kg, 0.3 mg/kg, 0.4 mg/kg, 0.5 mg/kg, 0.6 mg/kg, 0.8 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.2 mg/kg, 2.4 mg/kg, 2.6 mg/kg, 2.8 mg/kg, 3.0 mg/kg, 3.2 mg/kg, 3.4 mg/kg, 3.6 mg/kg, 3.8 mg/kg, 4.0 mg/kg, 4.4 mg/kg, 4.8 mg/kg, or 5.0 mg/kg.

In yet another exemplary embodiment, an anti-mesothelin bispecific binding protein that agonizes CD40 is administered once every 7 days at 0.005 mg/kg, 0.01 mg/kg, 0.02 mg/kg, 0.03 mg/kg, 0.04 mg/kg, 0.05 mg/kg, 0.06 mg/kg, 0.08 mg/kg, 0.1 mg/kg, 0.2 mg/kg, 0.3 mg/kg, 0.4 mg/kg, 0.5 mg/kg, 0.6 mg/kg, 0.8 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.2 mg/kg, 2.4 mg/kg, 2.6 mg/kg, 2.8 mg/kg, 3.0 mg/kg, 3.2 mg/kg, 3.4 mg/kg, 3.6 mg/kg, 3.8 mg/kg, 4.0 mg/kg, 4.4 mg/kg, 4.8 mg/kg, or 5.0 mg/kg.

When administered adjunctive to, or with, other agents, such as other chemotherapeutic agents, the bispecific binding proteins may be administered on the same schedule as the other agent(s), or on a different schedule. When administered on the same schedule, the bispecific binding protein may be administered before, after, or concurrently with the other agent. In some embodiments where a bispecific binding protein is administered adjunctive to, or with, standards of care, the bispecific binding protein may be initiated prior to commencement of the standard therapy, for example a day, several days, a week, several weeks, a month, or even several months before commencement of standard of care therapy.

In one exemplary embodiment, a bispecific binding protein is used adjunctive to nivolumab (OPDIVO®) to treat non-small cell lung cancer. In some embodiments, the bispecific binding protein binds CD40 and mesothelin. In specific embodiments, the bispecific binding protein is any one of SEQ ID NOS: 401, 402, 403, 404, 405, 406, 407, 408, 409, 410, 411, 412, 419, 420, and 421, e.g., a bispecific binding protein comprising two polypeptides having the same amino acid sequence chosen from the listed SEQ ID NOS. The bispecific binding protein is administered via IV infusion once every 14 days at 0.005 mg/kg, 0.01 mg/kg, 0.02 mg/kg, 0.03 mg/kg, 0.04 mg/kg, 0.05 mg/kg, 0.06 mg/kg, 0.08 mg/kg, 0.1 mg/kg, 0.2 mg/kg, 0.3 mg/kg, 0.4 mg/kg, 0.5 mg/kg, 0.6 mg/kg, 0.8 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.2 mg/kg, 2.4 mg/kg, 2.6 mg/kg, 2.8 mg/kg, 3.0 mg/kg, 3.2 mg/kg, 3.4 mg/kg, 3.6 mg/kg, 3.8 mg/kg, 4.0 mg/kg, 4.4 mg/kg, 4.8 mg/kg, or 5.0 mg/kg. Nivolumab is administered by intravenous infusion at a dose of 3 mg/kg over 60 minutes once every two weeks. The adjunctive bispecific binding protein/nivolumab therapy is continued until disease progression or no longer tolerated by the patient.

In another exemplary embodiment, a bispecific binding protein is used adjunctive to nivolumab (OPDIVO®) to treat non-small cell lung cancer. In some embodiments, the bispecific binding protein binds CD40 and mesothelin. In specific embodiments, the bispecific binding protein is any one of SEQ ID NOS: 401, 402, 403, 404, 405, 406, 407, 408, 409, 410, 411, 412, 419, 420, and 421, e.g., a bispecific binding protein comprising two polypeptides having the same amino acid sequence chosen from the listed SEQ ID NOS. The bispecific binding protein is administered via IV infusion once every 21 days at 0.005 mg/kg, 0.01 mg/kg, 0.02 mg/kg, 0.03 mg/kg, 0.04 mg/kg, 0.05 mg/kg, 0.06 mg/kg, 0.08 mg/kg, 0.1 mg/kg, 0.2 mg/kg, 0.3 mg/kg, 0.4 mg/kg, 0.5 mg/kg, 0.6 mg/kg, 0.8 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.2 mg/kg, 2.4 mg/kg, 2.6 mg/kg, 2.8 mg/kg, 3.0 mg/kg, 3.2 mg/kg, 3.4 mg/kg, 3.6 mg/kg, 3.8 mg/kg, 4.0 mg/kg, 4.4 mg/kg, 4.8 mg/kg, or 5.0 mg/kg. Nivolumab is administered by intravenous infusion at a dose of 3 mg/kg over 60 minutes once every two weeks. The adjunctive bispecific binding protein/nivolumab therapy is continued until disease progression or no longer tolerated by the patient.

In another exemplary embodiment, a bispecific binding protein is used adjunctive to nivolumab (OPDIVO®) to treat non-small cell lung cancer. In some embodiments, the bispecific binding protein binds CD40 and mesothelin. In specific embodiments, the bispecific binding protein is any one of SEQ ID NOS: 401, 402, 403, 404, 405, 406, 407, 408, 409, 410, 411, 412, 419, 420, and 421, e.g., a bispecific binding protein comprising two polypeptides having the same amino acid sequence chosen from the listed SEQ ID NOS. The bispecific binding protein is administered via IV infusion once every 28 days at 0.005 mg/kg, 0.01 mg/kg, 0.02 mg/kg, 0.03 mg/kg, 0.04 mg/kg, 0.05 mg/kg, 0.06 mg/kg, 0.08 mg/kg, 0.1 mg/kg, 0.2 mg/kg, 0.3 mg/kg, 0.4 mg/kg, 0.5 mg/kg, 0.6 mg/kg, 0.8 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.2 mg/kg, 2.4 mg/kg, 2.6 mg/kg, 2.8 mg/kg, 3.0 mg/kg, 3.2 mg/kg, 3.4 mg/kg, 3.6 mg/kg, 3.8 mg/kg, 4.0 mg/kg, 4.4 mg/kg, 4.8 mg/kg, or 5.0 mg/kg. Nivolumab is administered by intravenous infusion at a dose of 3 mg/kg over 60 minutes once every two weeks. The adjunctive bispecific binding protein/nivolumab therapy is continued until disease progression or no longer tolerated by the patient.

In another exemplary embodiment, a bispecific binding protein is used adjunctive to pembrolizumab (KEYTRUDA®) to treat non-small cell lung cancer. In some embodiments, the bispecific binding protein binds CD40 and mesothelin. In specific embodiments, the bispecific binding protein is any one of SEQ ID NOS: 401, 402, 403, 404, 405, 406, 407, 408, 409, 410, 411, 412, 419, 420, and 421, e.g., a bispecific binding protein comprising two polypeptides having the same amino acid sequence chosen from the listed SEQ ID NOS. The bispecific binding protein is administered via IV infusion once every 14 days at 0.005 mg/kg, 0.01 mg/kg, 0.02 mg/kg, 0.03 mg/kg, 0.04 mg/kg, 0.05 mg/kg, 0.06 mg/kg, 0.08 mg/kg, 0.1 mg/kg, 0.2 mg/kg, 0.3 mg/kg, 0.4 mg/kg, 0.5 mg/kg, 0.6 mg/kg, 0.8 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.2 mg/kg, 2.4 mg/kg, 2.6 mg/kg, 2.8 mg/kg, 3.0 mg/kg, 3.2 mg/kg, 3.4 mg/kg, 3.6 mg/kg, 3.8 mg/kg, 4.0 mg/kg, 4.4 mg/kg, 4.8 mg/kg, or 5.0 mg/kg. Pembrolizumab is administered by intravenous infusion at a dose of 2 mg/kg over 30 minutes once every three weeks. The adjunctive bispecific binding protein/pembrolizumab therapy is continued until disease progression or no longer tolerated by the patient.

In another exemplary embodiment, a bispecific binding protein is used adjunctive to pembrolizumab (KEYTRUDA®) to treat non-small cell lung cancer. In some embodiments, the bispecific binding protein binds CD40 and mesothelin. In specific embodiments, the bispecific binding protein is any one of SEQ ID NOS: 401, 402, 403, 404, 405, 406, 407, 408, 409, 410, 411, 412, 419, 420, and 421, e.g., a bispecific binding protein comprising two polypeptides having the same amino acid sequence chosen from the listed SEQ ID NOS. The bispecific binding protein is administered via IV infusion once every 21 days at 0.005 mg/kg, 0.01 mg/kg, 0.02 mg/kg, 0.03 mg/kg, 0.04 mg/kg, 0.05 mg/kg, 0.06 mg/kg, 0.08 mg/kg, 0.1 mg/kg, 0.2 mg/kg, 0.3 mg/kg, 0.4 mg/kg, 0.5 mg/kg, 0.6 mg/kg, 0.8 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.2 mg/kg, 2.4 mg/kg, 2.6 mg/kg, 2.8 mg/kg, 3.0 mg/kg, 3.2 mg/kg, 3.4 mg/kg, 3.6 mg/kg, 3.8 mg/kg, 4.0 mg/kg, 4.4 mg/kg, 4.8 mg/kg, or 5.0 mg/kg. Pembrolizumab is administered by intravenous infusion at a dose of 2 mg/kg over 30 minutes once every three weeks. The adjunctive bispecific binding protein/pembrolizumab therapy is continued until disease progression or no longer tolerated by the patient.

In another exemplary embodiment, a bispecific binding protein is used adjunctive to pembrolizumab (KEYTRUDA®) to treat non-small cell lung cancer. In some embodiments, the bispecific binding protein binds CD40 and mesothelin. In specific embodiments, the bispecific binding protein is any one of SEQ ID NOS: 401, 402, 403, 404, 405, 406, 407, 408, 409, 410, 411, 412, 419, 420, and 421, e.g., a bispecific binding protein comprising two polypeptides having the same amino acid sequence chosen from the listed SEQ ID NOS. The bispecific binding protein is administered via IV infusion once every 28 days at 0.005 mg/kg, 0.01 mg/kg, 0.02 mg/kg, 0.03 mg/kg, 0.04 mg/kg, 0.05 mg/kg, 0.06 mg/kg, 0.08 mg/kg, 0.1 mg/kg, 0.2 mg/kg, 0.3 mg/kg, 0.4 mg/kg, 0.5 mg/kg, 0.6 mg/kg, 0.8 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.2 mg/kg, 2.4 mg/kg, 2.6 mg/kg, 2.8 mg/kg, 3.0 mg/kg, 3.2 mg/kg, 3.4 mg/kg, 3.6 mg/kg, 3.8 mg/kg, 4.0 mg/kg, 4.4 mg/kg, 4.8 mg/kg, or 5.0 mg/kg. Pembrolizumab is administered by intravenous infusion at a dose of 2 mg/kg over 30 minutes once every three weeks. The adjunctive bispecific binding protein/pembrolizumab therapy is continued until disease progression or no longer tolerated by the patient.

As will be appreciated by those of skill in the art, the recommended dosages for the various agents described above may need to be adjusted to optimize patient response and maximize therapeutic benefit.

8. EXAMPLES

The following Examples, which highlight certain features and properties of the exemplary embodiments of the bispecific binding proteins described herein are provided for purposes of illustration, and not limitation.

Example 1—Generation and Characterization of Anti-CD40 Antibodies

8.1.1. Generation of Mouse Anti-Human CD40 Hybridoma

Monoclonal antibodies were generated by immunizing Balb/C mice or SJL mice intraperitoneally with mouse 3T12 cells overexpressing human CD40. Spleens were harvested, and splenocytes were fused with the multiple myeloma cell line NS0. Hybridomas were selected using aminopterin. Selected hybridomas expressing anti-CD40 antibodies with agonistic activities were screened and subcloned to isolate individual clones.

8.1.2. CD40 Assays

To screen for antibodies with agonistic activity, a panel of functional assays was developed, including NF-kB pathway stimulation, monocytes activation, DC activation and human CD40 ligand (SEQ ID NO:272) (CD40L) competition. In these assays, anti-human CD40 G28-5 (mouse IgG$_1$) (Biolegend) was included as positive control and an isotype matched mouse antibody (muIgG$_1$) as negative control.

8.1.2.1. HEK-Blue™ CD40 NF-κB Reporter Assay

HEK-Blue™ 293 CD40 cell line (InVivogen) stably expressing human CD40 and a NF-κB reporter gene were maintained in DMEM, 10% heat-inactivated fetal bovine serum (FBS), supplemented with 30 μg/mL Blasticidin and 100 μg/mL Zeocin. Activation of CD40 on the surface of HEK-Blue™ CD40 cells triggers a signaling cascade leading to the activation of NF-κB and the subsequent secretion of embryonic alkaline phosphatase (SEAP). Incubation of hybridoma supernatants containing agonistic anti-CD40 with $2.5 \times 10^5$/mL of HEK-Blue™ CD40 cells stimulated production of SEAP which could be measured by a colorimetic enzyme assay. The level of SEAP thus corresponded to the activity of anti-CD40 in the hybridoma supernatants.

8.1.2.2. Monocyte Activation Assay

The monocyte activity assay was performed using the monocytic cell line THP1-XBlue cells (InVivogen). This cell line stably expresses an NF-κB and AP-1-inducible SEAP reporter gene and was maintained in RPMI 1640 with 10% heat-inactivated FBS and 200 μg/mL Zeocin. In the assay, $5 \times 10^5$/mL THP1-XBlue cells were first primed with 40 ng/mL IFNγ for 24 hours, and were subsequently incubated with testing samples for an additional 24 hours. Agonistic anti-CD40 induced SEAP activity was monitored by enzymatic assay. Screening results and exemplary activity are summarized in Table 1-1.

8.1.2.3. Primary DC IL-12p70 Production Assay

Anti-CD40 clones were also screened for their ability to activate monocyte-derived dendritic cell (moDC). Activation was monitored by IL-12p70 production. Briefly, whole blood from healthy human donors, diluted with an equal volume of PBS, was added to a Leucosep (Greiner Bio One) tube, containing Ficoll-Paque Plus below the frit (15 mL). The blood was then centrifuged at 1,000 g for 15 minutes without brake. PBMC were collected and washed once with PBS, centrifuged at 1,300 rpm for 5 minutes at room temperature, and washed once with RPMI 1640. Cells were re-suspended in culture medium (RPMI1640+10% heat-inactivated FBS). Monocytes were subsequently isolated from PBMC with an enrichment kit from StemCell and were cultured in StemSep serum free medium supplemented with 10 ng/mL GM-CSF and 20 ng/mL IL-4 at 37° C., 5% CO$_2$ for 6 days. Fresh GM-CSF and IL-4 were added to the culture at day 3 to help maintaining DC differentiation. After 6 days culture, monocyte-derived immature DC were subject to FACS analysis to verify immature DC phenotype: Lin−, CD80/CD86+, HLA-DR+, CD11c+. Immature moDC were primed with IFNγ and stimulated with samples containing anti-CD40 for 48 hours in StemSep serum free medium supplemented with GM-CSF and IL-4. The culture supernatant was harvest and assayed for IL-12p70 production by a commercially available ELISA kit. The screening results and representative activity are summarized in Table 1-1.

TABLE 1-1

Summary of agonistic anti-CD40 clone screen

| Clone | Monocyte activation[1] (THP1-Xblue, $OD_{655}$) | moDC activation (IL-12p70, pg/mL) |
|---|---|---|
| AD163.7.2 | 0.13 | 905.3 |
| AD163.9.3 | 0.19 | 2216.3 |
| AD163.10.7 | 0.16 | 1318.8 |
| AD163.27.12 | 0.12 | 1514.5 |
| AD163.162.1 | 0.11 | 2155.5 |
| AD164.14.6 | 0.15 | 878 |
| AD164.76.3 | 0.16 | 769.8 |
| AD165.1.2 | 0.14 | 719.8 |
| AD166.4.4 | 0.24 | 0 |
| AD175.14.11 | 0.2 | 0 |
| G28-5 | 0.12 | 138.8 |
| $muIgG_1$ | 0.06 | 0 |

[1]Monocyte activation is SEAP activity released from THP1-XBlue cells recorded at $OD_{655}$ 8.1.3. Variable Region Sequencing and Humanization of Murine Anti-CD40 Antibodies The cDNA sequences encoding the heavy and light chain variable regions of ten monoclonal antibodies (Table 1-2) were cloned from hybridomas AD163.9.3, AD166.4.4, AD175.14.11, AD163.10.7, AD165.1.2, AD163.162.1, AD163.27.12, AD163.7.2, AD 164.14.6, and AD164.76.3, respectively, using standard PCR techniques and were sequenced using standard DNA sequencing techniques. The full amino acid sequences are shown in FIGS. 3A-3C.

TABLE 1-2

Murine anti-CD40 antibodies

| Antibody | Clone | $V_H$ Identifier | $V_L$ Identifier |
|---|---|---|---|
| muAb1 | AD163.9.3 | SEQ ID NO: 1 | SEQ ID NO: 31 |
| muAb2 | AD166.4.4 | SEQ ID NO: 2 | SEQ ID NO: 32 |
| muAb3 | AD175.14.11 | SEQ ID NO: 3 | SEQ ID NO: 33 |
| muAb4 | AD163.10.7 | SEQ ID NO: 4 | SEQ ID NO: 34 |
| muAb5 | AD165.1.2 | SEQ ID NO: 5 | SEQ ID NO: 35 |
| muAb6 | AD163.162.1 | SEQ ID NO: 6 | SEQ ID NO: 36 |
| muAb7 | AD163.27.12 | SEQ ID NO: 6 | SEQ ID NO: 37 |
| muAb8 | AD163.7.2 | SEQ ID NO: 7 | SEQ ID NO: 38 |
| muAb9 | AD164.14.6 | SEQ ID NO: 8 | SEQ ID NO: 39 |
| muAb10 | AD164.76.3 | SEQ ID NO: 9 | SEQ ID NO: 40 |

Humanization of the antibody V region was carried out as outlined by Queen, C. et al. (Proc. Natl. Acad. Sci. USA, 1989; 86:10029-10033), and the sequences of the resulting antibodies are summarized in Table 1-3. The canonical structures of the CDRs were determined according to Huang et al. (Methods, 2005; 36:35-42). Human variable germline sequences with the same or most similar CDR canonical structures were identified, and appropriate human $V_H$, $V_L$, and J segment sequences were selected to provide the frameworks for the anti-CD40 variable region. At framework positions in which the computer model suggested significant contact with the CDRs, the amino acids from the murine anti-CD40 V regions were substituted for the original human framework amino acids (back-mutations). Full amino acid sequences are shown in FIGS. 3D-3G.

TABLE 1-3

Humanized anti-CD40 antibodies

| Antibody | Corresponding Murine Clone | $V_H$ Identifier | $V_L$ Identifier |
|---|---|---|---|
| huAb6-1 | AD163.162.1 | SEQ ID NO: 10 | SEQ ID NO: 41 |
| huAb6-2 | AD163.162.1 | SEQ ID NO: 11 | SEQ ID NO: 41 |
| huAb6-3 | AD163.162.1 | SEQ ID NO: 12 | SEQ ID NO: 41 |
| huAb8-1 | AD163.7.2 | SEQ ID NO: 13 | SEQ ID NO: 42 |
| huAb8-2 | AD163.7.2 | SEQ ID NO: 14 | SEQ ID NO: 42 |
| huAb8-3 | AD163.7.2 | SEQ ID NO: 15 | SEQ ID NO: 42 |
| huAb9-1 | AD164.14.6 | SEQ ID NO: 16 | SEQ ID NO: 43 |
| huAb9-2 | AD164.14.6 | SEQ ID NO: 17 | SEQ ID NO: 43 |
| huAb9-3 | AD164.14.6 | SEQ ID NO: 18 | SEQ ID NO: 43 |
| huAb9-4 | AD164.14.6 | SEQ ID NO: 16 | SEQ ID NO: 44 |
| huAb9-5 | AD164.14.6 | SEQ ID NO: 17 | SEQ ID NO: 44 |
| huAb9-6 | AD164.14.6 | SEQ ID NO: 18 | SEQ ID NO: 44 |
| huAb9 A2I | AD164.14.6 | SEQ ID NO: 17 | SEQ ID NO: 50 |
| huAb9 A2V | AD164.14.6 | SEQ ID NO: 17 | SEQ ID NO: 51 |

Anti-CD40 clone AD163.162.1 was humanized according to the method described above. The humanized versions of AD163.162.1 were huAb6-1, huAb6-2 and huAb6-3. Antibody huAb6-1 had a $V_H$ (SEQ ID NO:10) with framework back-mutations M48I, V67A, I69L, and A71V. Antibody huAb6-2 had a $V_H$ (SEQ ID NO:11) with framework back-mutations M48I and A71V. Antibody huAb6-3 had a $V_H$ (SEQ ID NO:12) with framework back-mutations M48I and A71V, as well as $V_H$ CDR germlining changes N60A, K64Q and D65G to improve identity to human germline sequence. Antibodies huAb6-1, huAb6-2 and huAb6-3 had a $V_L$ (SEQ ID NO:41) with framework back-mutations A43S, L46R, L47W and F71Y.

The humanized versions of anti-CD40 clone 163.7.2 were huAb8-1, huAb8-2 and huAb8-3 (FIGS. 3D, 3E). Antibody huAb8-1 had a $V_H$ (SEQ ID NO:13) with framework back-mutations M48I, V67A, I69L, A71V, K73R, Y91F, and R94S. Antibody huAb8-2 had a $V_H$ (SEQ ID NO:14) with framework back-mutations M48I, V67A, I69L, A71V, K73R, Y91F, and R94S, as well as the $V_H$ CDR C59S mutation. Antibody huAb8-3 had a $V_H$ (SEQ ID NO:15) with framework back-mutations M48I, A71V and R94S. Antibodies huAb8-1, huAb8-2 and huAb8-3 all had a $V_L$ (SEQ ID NO:42) with the framework back-mutations A43S and Y87F.

Anti-CD40 clone AD164.14.6 was humanized to provide huAb9-1, huAb9-2, huAb9-3, huAb9-4, huAb9-5 and huAb9-6. Antibodies huAb9-1 and huAb9-4 displayed a $V_H$ (SEQ ID NO:16) with framework back-mutations: I48M, V67I and V71R. Antibodies huAb9-2 and huAb9-5 had a $V_H$ (SEQ ID NO: 17) with framework back-mutations I48M and V71R. Antibodies huAb9-3 and huAb9-6 had a $V_H$ (SEQ ID NO: 18) with framework back-mutations: I48M and V71R, as well as additional two CDR germline changes T30S and N65S to improve identity to human germline sequence. Antibodies huAb9-1, huAb9-2 and huAb9-3 had a $V_L$ (SEQ ID NO: 43) with framework back-mutations I2A, Y36F and Y87F. Antibodies huAb9-4, huAb9-5 and huAb9-6 had a $V_L$ (SEQ ID NO: 44) with the framework back-mutation I2A.

Clone AD164.14.6 was further modified to remove a signal peptide cleavage site found at the second position of the light chain, by reverting the framework back-mutation I2A of the $V_L$. Antibodies huAb9 A2I (SEQ ID NO:50) and huAb9 A2V (SEQ ID NO:51) containing framework mutations A2I and A2V, respectively, prevented the formation of an undesired cleavage product.

Humanized antibodies in the present Example were generated with a human IgG1 heavy chain constant region and kappa light chain constant region. The C-terminal lysine may be partially cleaved by post-translational processing after protein expression of the human IgG1 heavy chain. Accordingly, huAb9-5 had a heavy chain according to SEQ ID NOS:310 or 311 and a light chain according to SEQ ID NO:320. Antibody huAb9-5 also was produced with V273E and V273Y amino acid mutations in the heavy chain constant region, corresponding to a heavy chain according to SEQ ID NOS:312 or 313 and SEQ ID NOS:314 or 315, respectively, and a light chain according to SEQ ID NO:320. Antibodies huAb9 A2I and huAb9 A2V were generated with a human IgG1 V273E heavy chain constant region. Accordingly, huAb9 A2I had a heavy chain according to SEQ ID NOS:312 or 313 and a light chain according to SEQ ID NO:321. Analogously, huAb9 A2V had a heavy chain according to SEQ ID NOS:312 or 313 and a light chain according to SEQ ID NO:322.

8.1.4. NF-κB Activation, CD40 Binding Kinetics, Species Cross-Reactivity and Epitope Class of the Humanized Antibodies NF-κB activation by humanized anti-CD40 antibody of the invention was evaluated in HEK-Blue™ 293 CD40 NFκB reporter cells. The activation was represented as SEAP (secreted embryonic alkaline phosphatase) reporter gene activity measured at $OD_{655}$. The maximal $OD_{655}$ measured and the concentration for half-maximal activation ($EC_{50}$) are summarized in Table 1-4.

TABLE 1-4

NF-κB activation in HEK293 CD40 NFκB reporter cells

| Antibody | $EC_{50}$ (μg/mL) | Maximal activation ($OD_{655}$) |
|---|---|---|
| huAb6-1 | 1.09 | 0.26 |
| huAb6-2 | 1.21 | 0.20 |
| huAb6-3 | 4.31 | 0.32 |
| huAb8-1 | 0.14 | 0.45 |
| huAb8-3 | 0.07 | 0.46 |
| huAb9-1 | 0.19 | 0.26 |
| huAb9-2 | 0.29 | 0.27 |
| huAb9-3 | 0.18 | 0.27 |
| huAb9-4 | 5.55 | 0.61 |
| huAb9-5 | 1.13 | 0.67 |
| huAb9-6 | 5.95 | 0.54 |

The binding affinities of humanized anti-CD40 antibodies of the invention were analyzed by both surface plasmon resonance and FACS analysis.

CD40 binding kinetics was analyzed by surface plasmon resonance assay with a Biacore T200 instrument (Table 1-5). Briefly, a goat anti-mouse Fc antibody (Pierce) or goat anti-human Fc (Pierce) was immobilized on a CM5 sensor chip, followed by capture of the anti-CD40 antibodies on the test surface. Subsequently, the soluble form of the extracellular domain of human CD40 (Creative BioMart) or cynomolgus (cyno) CD40 (Creative BioMart) was injected, and the binding and dissociation were measured.

Surface plasmon resonance data indicated that humanized huAb8-1 and huAb9-5 antibody retained similar binding affinities ($K_D$) as that of their parental clones AD163.7.2 or clone AD164.14.6, respectively, and showed similar binding to human and cynomolgus CD40 (Table 1-5).

TABLE 1-5

Affinity measured by surface plasmon resonance*

| clone or antibody | Human CD40 | | | Cynomolgus CD40 | | |
|---|---|---|---|---|---|---|
| | $k_a$ (1/M-s) | $k_d$ (1/s) | $K_D$ (M) | $k_a$ (1/M-s) | $k_d$ (1/s) | $K_D$ (M) |
| AD163.162.1 | 7.6E+04 | 4.8E−03 | 6.3E−08 | — | — | — |
| AD163.27.12 | 7.5E+04 | 4.8E−03 | 6.4E−08 | — | — | — |
| AD163.7.2 | 1.0E+06 | 4.2E−03 | 4.1E−09 | — | — | — |
| AD175.14.11 | 6.9E+04 | 1.2E−02 | 1.7E−07 | — | — | — |
| AD163.9.3 | 4.7E+05 | 1.6E−02 | 3.5E−08 | — | — | — |
| AD166.4.4 | 2.8E+06 | 9.6E−03 | 3.5E−09 | — | — | — |
| AD163.10.7 | 2.3E+06 | 1.7E−01 | 7.6E−08 | — | — | — |
| AD165.1.2 | 2.3E+06 | 2.0E−03 | 8.8E−10 | — | — | — |
| AD164.76.3 | 2.6E+06 | 3.4E−02 | 1.3E−08 | — | — | — |
| AD164.14.6 | 2.8E+06 | 5.2E−02 | 1.9E−08 | — | — | — |
| huAb8-1 | 7.7E+05 | 2.3E−03 | 3.0E−09 | 1.0E+06 | 7.1E−03 | 7.1E−09 |
| huAb9-5 | 1.7E+06 | 2.6E−02 | 1.5E−08 | 1.8E+06 | 2.4E−02 | 1.3E−08 |

*Numbers refer to exponential notation, e.g., 3.0E−09 = 3.0 × $10^{-9}$.

The humanized anti-CD40 antibodies were also evaluated for binding to cell-surface CD40 on HEK293 cells stably transfected with human or cynomolgus CD40, as well as B cells derived from cynomolgus or human PBMC. Humanized anti-CD40 antibodies were incubated with HEK293 transfectants for 15 minutes on ice, and the binding was detected with a fluorescence-conjugated anti-human secondary antibody (Jackson ImmunoResearch). FACS analysis of the cells confirmed that the humanized antibodies bound to human and cynomolgus CD40 stable cell lines. No binding was observed in experiments performed with mouse or dog CD40.

The anti-CD40 antibodies were also assessed for their ability to bind to primary human and cynomolgus CD40-expressing cells. PBMCs isolated from human or cynomolgus blood were incubated with anti-CD40 antibodies conjugated to the fluorescence dye CF640R. After FACS analysis, the data were analyzed by FlowJo (FlowJo, LLC) software. These results demonstrated that the humanized antibodies bound to primary CD40-positive cells derived from both human and cynomolgus PBMC.

Epitope classification of the humanized antibodies of the invention was confirmed by an ELISA assay measuring the binding of anti-CD40 and CD40 complex to plate-bound human CD40L (SEQ ID NO:272). Increasing amounts of humanized anti-CD40 antibodies or human IgG1 control antibody were incubated with 1 μg/mL CD40-huFc fusion protein, and added to a plate coated with CD40L. The signal from an uncoated plate was defined as background. Humanized antibodies huAb8-3 and huAb8-1 blocked the interaction of CD40 and CD40L; and huAb6-1 and huAb6-2 showed minimal impact on CD40-CD40L interaction. Data for huAb9-5 and huAb9-6 suggested that the antibodies enhanced CD40 binding to CD40L.

8.1.5. Enhancing FcγRIIB Binding by Modifying Fc Regions of Anti-CD40 Antibodies Greater agonistic activity of CD40 can be achieved through modifying the Fc region to enhance FcγRIIB binding (Li and Ravetch, Science, 2011; 333:1030-1034; and White, et al., J. Immunol, 2011; 187:1754-1763). Two mutations, V273E and V273Y, at position 273 in the human IgG1 constant region were introduced into the humanized anti-CD40 antibodies. The impact of the Fc mutations on binding to Fcγ receptors was monitored by FACS analysis and by antibody-dependent cell-mediated cytotoxicity (ADCC).

Increasing amounts of anti-CD40 human $IgG_1$ antibodies and their Fc variants were incubated with CHO cells stably expressing different human Fcγ receptors, including FcγRI (CD64), FcγRIIA (CD32A), FcγRIIB (CD32B), and FcγRIIIA with either F or V polymorphism. The binding was detected with a fluorescence-conjugated anti-human $F(ab')_2$ specific secondary antibody (Jackson ImmunoResearch). The mutations V273E or V273Y reduced binding to FcγRIIIA while maintaining or enhancing FcγRIIB binding.

The ADCC of the Fc variants of the humanized anti-CD40 antibodies was measured using a standard protocol (Law et al., 2005, Cancer Res. 65:8331-8). The mutations V273E or V273Y reduced ADCC activity mediated by human $IgG_1$ Fc on CD40-expressing cells.

8.1.6. In vitro agonistic activity of anti-human CD40 with Fc modifications

The agonistic activities of anti-CD40 Fc variants were evaluated for their ability to stimulate B cell proliferation, IL-12p70 production by DCs, and IFNγ production in an allogeneic DC and T cell mixed culture.

8.1.6.1. B Cell Proliferation

Human B cells were enriched by B cell enrichment kit (StemCell Technologies) through negative selection. The purified B cells were seeded into 96 well plates at $5 \times 10^5$/mL, 200 μL per well in AIM-V serum free medium (GIBCO). Serially diluted anti-CD40 antibodies were added and cultured with B cells for 6 days. In the last 16 hours of culture, 1 μCi of $H^3TdR$ were added to each well of the culture and B cell proliferation was determined by $H^3TdR$ incorporation. The radioactivity associated with $H^3TdR$ incorporation was recorded by a scintillation counter as count per minute (CPM). Compared to the corresponding human $IgG_1$ wild-type antibodies, the anti-CD40 human $IgG_1$ Fc variants V273E and V273Y showed enhanced B cell activation.

8.1.6.2. DC IL-12p70 Production

Immature DCs were first derived from monocytes purified from human PBMC and treated with IL-4 and GM-CSF. DC maturation and IL-12p70 production were induced by anti-CD40 antibodies after priming with IFNγ. The wild-type human $IgG_1$ versions of the anti-CD40 antibodies huAb6-1, huAb8-1, and huAb9-5 showed potent activity in stimulating DCs to produce IL-12p70. The V273E or V273Y Fc mutated versions maintained or enhanced their potency on DC activation.

8.1.6.3. Allogeneic DC and T Cell Co-Culture

Dendritic cells ($5 \times 10^3$), derived from monocytes using the method described above, were mixed with $1 \times 10^5$ T cells purified from a different donor. Various amounts of anti-CD40 antibodies huAb6-1, huAb8-1, huAb9-5 bearing either the wild-type human IgG1 constant region or an Fc variant were added to the DC and T cell co-culture. After 4 days incubation, supernatants were collected and IFNγ was measured by ELISA.

Anti-CD40 antibodies huAb6-1, huAb8-1, and huAb9-5 increased IFNγ production in autologous DC and T cells co-cultures. The production of IFNγ represents the activation of T cells and potential T cell-mediated cytotoxicity. HuAb9-5 and huAb8-1 were more potent than huAb6-1 in stimulating T cells.

8.1.7. In Vivo Anti-Tumor Activity of Anti-Human CD40 Antibody

The humanized anti-CD40 antibodies huAb6-1, huAb8-1, and huAb9-5, with wild-type human IgG1 and Fc variants were assessed for their ability to inhibit tumor growth in NSG mice bearing the prostate cancer xenograft, PC3.

NSG mice were inoculated subcutaneously with a mixture of PC3 cells ($1 \times 10^6$), purified T cells ($5 \times 10^5$), and autologous DCs ($1 \times 10^5$). A single dose of the anti-CD40 antibodies or control antibodies at 2 mg/kg was injected intraperitoneally immediately after inoculation. Tumor volumes were measured every other day with calipers. Anti-CD40 antibodies including huAb6-1, huAb8-1, huAb9-5 and the corresponding V273E or V273Y Fc variants inhibited PC3 tumor growth.

Example 2—Generation and Characterization of Anti-Mesothelin Antibodies 8.2.1. Generation of Fully Human Anti-Human Mesothelin Antibodies Fully human anti-mesothelin antibodies were generated through an in vitro RNA display technology (Hseh, C-M., Kutskova, Y. A. and Memmott, J. E., US Patent Appl. No. US2010/0105569) and subsequent affinity maturation to afford the anti-mesothelin antibody HuAb17.

Sequence alignment showed that the mesothelin antibody HuAb17 shares the highest identity to human germlines VH1-463H4 and IGLV3-1/Jk2. To improve the affinity of HuAb17 to mesothelin, hypermutated CDR residues were identified from other human antibody sequences in the IgBLAST database that also shared high identity to germlines VH1-46 and IGLV3-1. The corresponding HuAb17 CDR residues were then subjected to limited mutagenesis by PCR with primers having low degeneracy at these hypermutated CDR positions to create three antibody libraries in the scFv format suitable for surface display. The first library contained mutations at residues 30, 31, 33, 34, 50, 53, 56 and 58 in $V_H$ CDR#1 and $V_H$ CDR#2 (Kabat numbering); the second library at residues 95 to 100 d in $V_H$ CDR#3; and the third library at residues 27, 30, 31, 33, 52, 53 and 93 to 96 in the three $V_L$ CDRs. For further mutations of HuAb17 to align it closer to the human germline framework sequences, a binary degeneracy at $V_H$ positions D27Y and V55G was introduced. Also, the following positions were germline: $V_H$ at positions 13, 37, 74, 76, 82a, 84, 91, and 94; and $V_L$ at positions 20 and 100. The HuAb17 libraries were displayed and selected against a low concentration of biotinylated mesothelin by magnetic then fluorescence activated cell sorting. The parental HuAb17 and its affinity matured variants are listed in Table 2-1. The amino acid sequences of the heavy or light chain variable region of each clone are shown in FIGS. 4A-4E.

TABLE 2-1

Affinity matured human anti-mesothelin antibodies based on HuAb17

| Antibody | V$_H$ Identifier | V$_L$ Identifier |
|---|---|---|
| HuAb17 | SEQ ID NO: 107 | SEQ ID NO: 136 |
| HuAM1 | SEQ ID NO: 108 | SEQ ID NO: 137 |
| HuAM2 | SEQ ID NO: 109 | SEQ ID NO: 137 |
| HuAM3 | SEQ ID NO: 110 | SEQ ID NO: 137 |
| HuAM4 | SEQ ID NO: 111 | SEQ ID NO: 137 |
| HuAM5 | SEQ ID NO: 112 | SEQ ID NO: 137 |
| HuAM6 | SEQ ID NO: 113 | SEQ ID NO: 137 |
| HuAM7 | SEQ ID NO: 114 | SEQ ID NO: 137 |
| HuAM8 | SEQ ID NO: 115 | SEQ ID NO: 138 |
| HuAM9 | SEQ ID NO: 116 | SEQ ID NO: 137 |
| HuAM11 | SEQ ID NO: 117 | SEQ ID NO: 139 |
| HuAM12 | SEQ ID NO: 118 | SEQ ID NO: 137 |
| HuAM13 | SEQ ID NO: 119 | SEQ ID NO: 139 |
| HuAM14 | SEQ ID NO: 117 | SEQ ID NO: 137 |
| HuAM15 | SEQ ID NO: 120 | SEQ ID NO: 137 |
| HuAM16 | SEQ ID NO: 119 | SEQ ID NO: 137 |
| HuAM17 | SEQ ID NO: 121 | SEQ ID NO: 137 |
| HuAM18 | SEQ ID NO: 122 | SEQ ID NO: 137 |
| HuAM19 | SEQ ID NO: 123 | SEQ ID NO: 140 |
| HuAM21 | SEQ ID NO: 124 | SEQ ID NO: 137 |

8.2.2. Mesothelin Binding Kinetics and Species Cross-Reactivity of Fully Human Anti-Mesothelin Antibodies The fully human anti-mesothelin antibodies were measured for binding affinity to human and cynomolgus mesothelin by surface plasmon resonance using the method described above. The binding kinetics of human anti-mesothelin parental antibody HuAb17 and its affinity matured variants for human and cynomolgus mesothelin are summarized in Table 2-2.

TABLE 2-2

Exemplary binding kinetics of human anti-mesothelin antibodies*

| | human mesothelin | | | cynomolgus mesothelin | | |
|---|---|---|---|---|---|---|
| Antibody | k$_a$ (1/M-s) | k$_d$ (1/s) | K$_D$ (M) | k$_a$ (1/M-s) | k$_d$ (1/s) | K$_D$ (M) |
| HuAb17 | 1.2E+04 | 3.2E−05 | 2.6E−09 | 1.5E+04 | 1.3E−04 | 8.1E−09 |
| HuAM1 | 1.9E+04 | 5.1E−05 | 2.7E−09 | 1.8E+04 | 2.0E−04 | 1.1E−08 |
| HuAM5 | 2.3E+04 | 1.0E−05 | 4.6E−10 | 2.0E+04 | 1.0E−04 | 4.9E−09 |
| HuAM6 | 2.4E+04 | 2.4E−05 | 1.0E−09 | 2.2E+04 | 8.5E−05 | 3.9E−09 |
| HuAM7 | 2.6E+04 | 1.0E−05 | 3.9E−10 | 2.2E+04 | 1.1E−04 | 4.9E−09 |
| HuAM15 | 4.4E+04 | 1.3E−05 | 3.1E−10 | 4.0E+04 | 1.8E−04 | 4.5E−09 |
| HuAM16 | 5.2E+04 | 2.4E−05 | 4.6E−10 | 4.7E+04 | 1.9E−04 | 4.1E−09 |
| HuAM17 | 2.9E+04 | 1.5E−05 | 5.3E−10 | 2.7E+04 | 9.1E−05 | 3.4E−09 |
| HuAM18 | 1.6E+04 | 1.0E−05 | 6.6E−10 | 1.4E+04 | 1.3E−04 | 9.3E−09 |

*Numbers refer to exponential notation, e.g., 3.0E−09 = 3.0 × 10$^{-9}$.

8.2.3. In Vitro Binding of Affinity Matured Human Anti-Mesothelin in the Presence of CA125

Mesothelin is highly expressed on some solid tumors, including mesothelioma, ovarian cancer, and pancreatic cancer, and is often co-expressed with another tumor antigen, CA125 (MUC16). It has been reported that mesothelin can interact with CA125 to mediate cell adhesion (Rump A., et. al., *J. Biol. Biochem.* 2004, 279: 9190-9198). To determine whether the anti-mesothelin antibodies described herein can bind to mesothelin in a tumor microenvironment enriched with CA125, the binding of the anti-mesothelin affinity matured variants was measured on tumor cell lines with or without endogenous CA125 expression.

The binding of anti-mesothelin affinity matured variants was measured by FACS on the ovarian cancer cell line OVCAR3, the pancreatic cancer cell line SW1990, and the renal cancer cell line SN12C. Both OVCAR3 and SW1990 express CA125, but CA125 expression on SN12C cells was not detected. The maximum binding and the concentration of half maximum binding on SN12C and OVCAR3 are summarized in Table 2-3, which shows the binding kinetics of human anti-mesothelin affinity matured antibodies on mesothelin positive tumor cell lines with endogenous mesothelin expression with CA125 expression (CA125+) or without (CA125−).

TABLE 2-3

Binding kinetics of human anti-mesothelin affinity matured antibodies

| | SN12C (CA125−) | | OVCAR3 (CA125+) | |
|---|---|---|---|---|
| Antibody | Maximum binding (MFI) | EC$_{50}$ (μg/mL) | Maximum binding (MFI) | EC$_{50}$ (μg/mL) |
| HuAb17 | 10972 | 2.74 | 1641 | 2.9 |
| HuAM5 | 10026 | 0.09 | 3693 | 0.7 |
| HuAM11 | 7534 | 0.04 | 3434 | 0.7 |
| HuAM12 | 9629 | 0.09 | 3268 | 0.8 |
| HuAM13 | 9868 | 0.09 | 3672 | 0.7 |
| HuAM14 | 9804 | 0.09 | 3371 | 0.7 |
| HuAM15 | 9389 | 0.07 | 3551 | 0.7 |
| HuAM16 | 9535 | 0.08 | 3612 | 0.6 |
| HuIgG1 control | 40 | — | 70 | — |

Figure 5A:
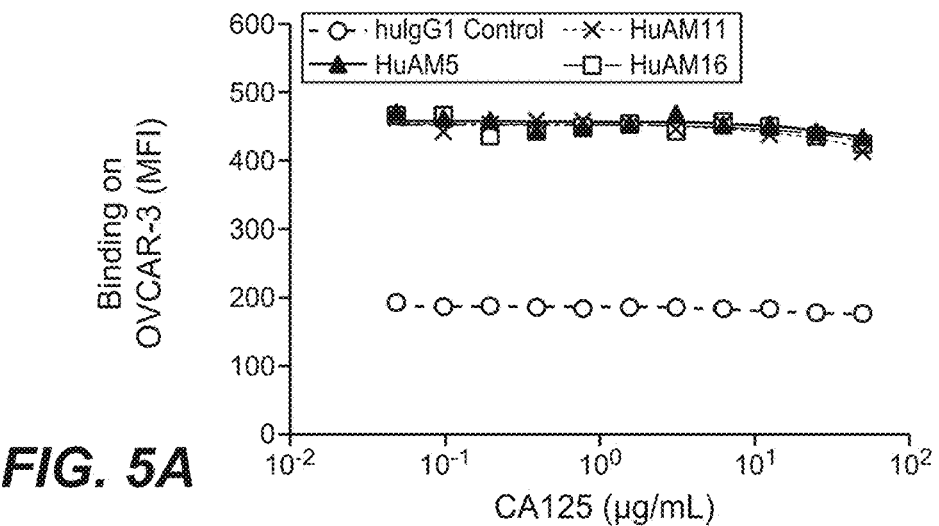
Figure 5B:
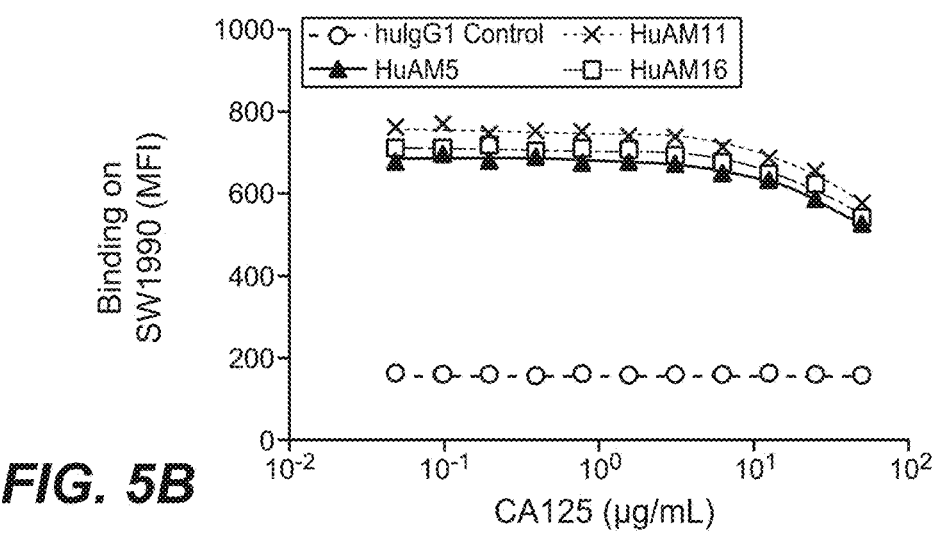
Figure 5C:
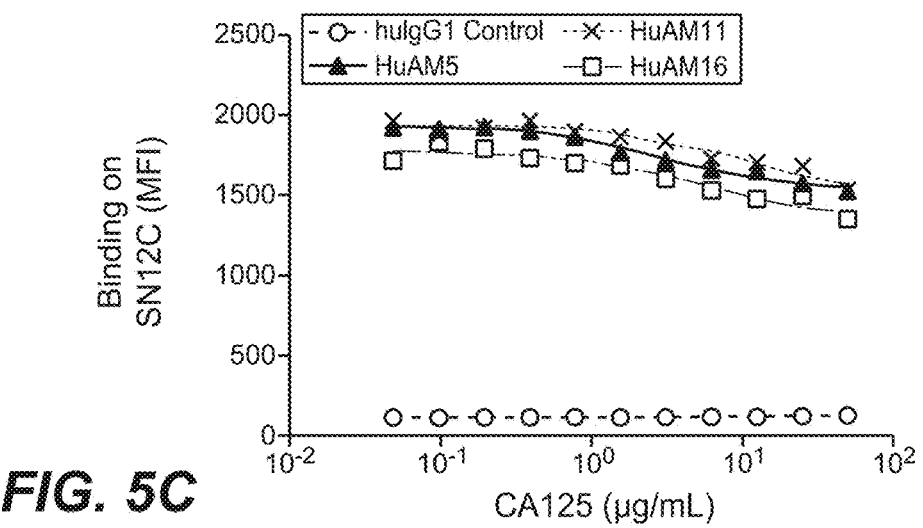
Figure 6A:
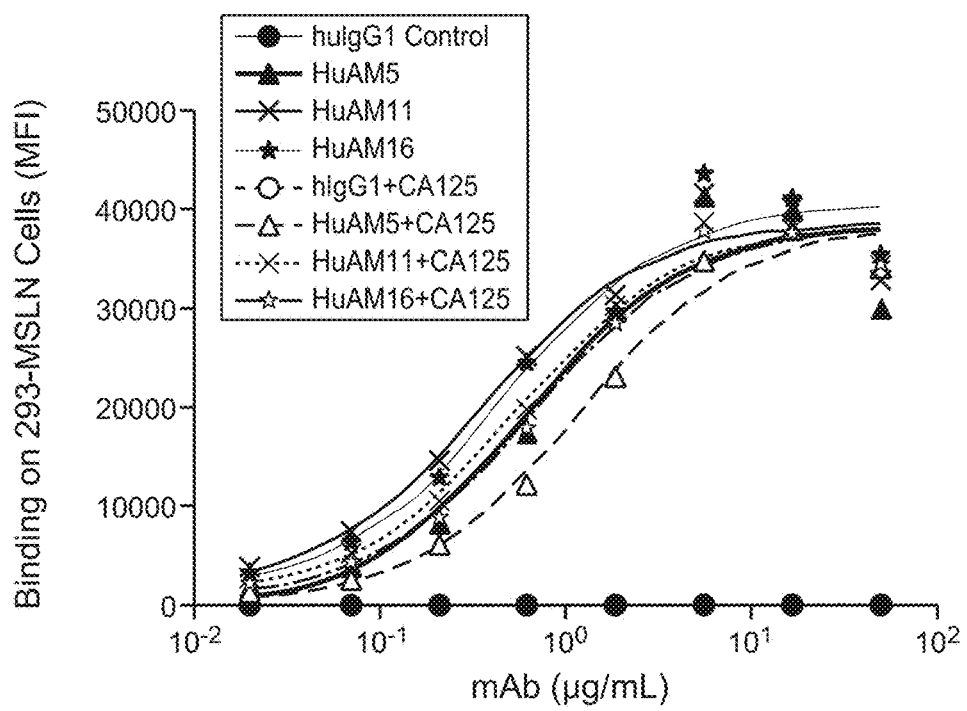
Figure 6B:
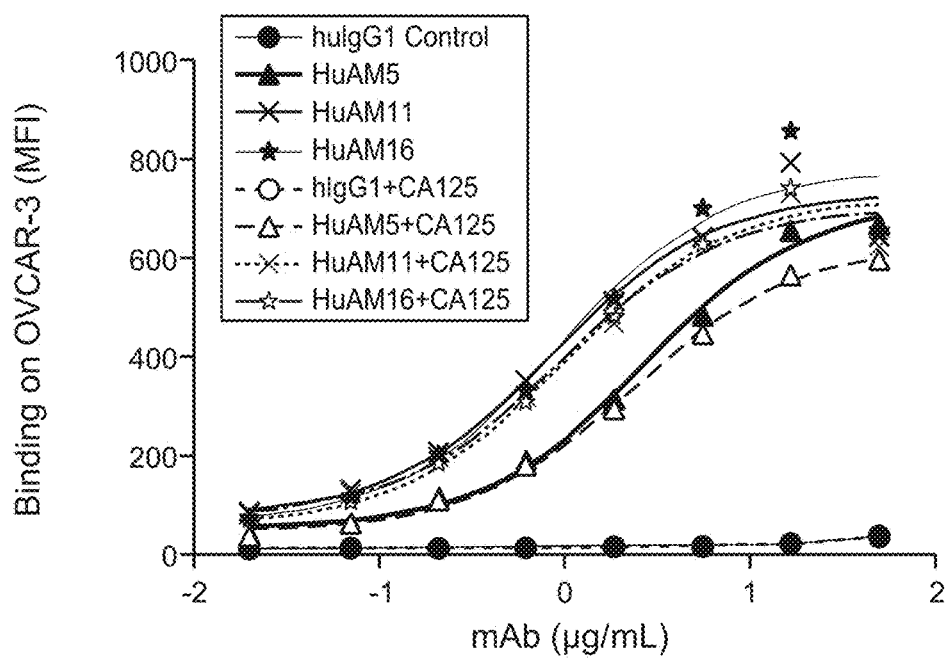

To measure the impact of soluble CA125 on anti-mesothelin antibody binding, antibodies at a sub-optimal concentration (0.5 μg/mL) were added to cancer cells pre-incubated with increasing amounts of soluble CA125. The mesothelin binding of antibodies in the presence of CA125 was detected with a fluorescence-conjugated goat-anti-human secondary antibody. As depicted in FIGS. 5A-5C, representative anti-mesothelin affinity matured variants showed consistent binding to different tumor cell lines in the presence of increasing amounts of soluble CA125. The binding curves of the anti-mesothelin affinity matured variants on OVCAR3 cells, as well as HEK293 cells stably expressing mesothelin, were also not significantly shifted in the presence of soluble CA125 (FIGS. 6A-6B).

Example 3—Generation and Characterization of Anti-4-1BB Antibodies 8.3.1. Anti-4-1BB Antibodies Via Rat and Mouse Hybridoma Technology Rats and mice were immunized according to the methods known in the art (E. Harlow, D. Lane. Antibody: A Laboratory Manual, (Cold Spring Harbor Laboratory Press, Cold Spring Harbor, N.Y., 1998)). Recombinant mouse 4-1BB-ECD-human Fc fusion or mouse 4-1BB-ECD-his proteins were used as immunogens. Human cell lines expressing human and mouse 4-1BB were used for determining antisera titer and for screening antigen-specific antibodies. Sprague-Dawley rats were immunized in the hock with dosages containing 10 µg protein per animal per injection in the presence of Gerbu MM adjuvant (Cooper-Casey Corporation) for both primary and boost immunizations. To increase immune response to the counter species 4-1BB, the animals were further boosted with a mixture of human and mouse 4-1BB-ECD-his proteins for the final boosts.

8.3.2. Hybridoma Fusion and Screening

Cells of murine myeloma cell line NS0 were cultured to reach the log phase stage right before fusion. Popliteal and inguinal lymph nodes were removed from each mouse and single cell suspensions were prepared in a sterile manner. Lymphocytes were fused with myeloma cells according the methods known in the art (E. Harlow, D. Lane. Antibody: A Laboratory Manual, (Cold Spring Harbor Laboratory Press, Cold Spring Harbor, N.Y., 1998); Kohler G. and Milstein C., *Nature*, 256:495-497 (1975); BTX Harvard Apparatus (Holliston, Mass., US) ECM 2001 technical manual). Fused hybrid cells were dispensed into 96-well plates in DMEM/10% FBS/HAT media. Supernatants from surviving hybridoma colonies were subjected to cell-based screening using human cell lines expressing the recombinant human 4-1BB or mouse 4-1BB.

Hits were expanded and binding specificity was confirmed by FACS using a human cell line expressing the human 4-1BB, cynomolgus 4-1BB, and mouse 4-1BB and Goat anti-rat IgG-PE (Jackson Immunochemicals) or Goat anti-mouse IgG-PE (Jackson Immunochemicals) for detection. A selection of hits were subcloned using the MoFlo (Beckman) by depositing a single cell per well into 96 well cell culture plates to ensure clonality of the cell line. The resulting colonies were screened for specificity by FACS using human cell lines expressing the human 4-1BB protein, cynomolgus 4-1BB or mouse 4-1BB. Isotype of each monoclonal antibody was determined using the Rat Monoclonal Isotyping kit (Serotec) or the Mouse Isotyping kit (Roche). Hybridoma clones producing antibodies of interest were purified and further characterized for affinity by surface plasmon resonance, potency (NFκB reporter assay), and ligand competition (ELISA). Amino acid sequences of $V_H$ and $V_L$ regions of exemplary murine antibodies TABBY1.1 to TABBY10, or rat antibodies TABBY101 to TABBY108 are shown in FIGS. 7A-7C, and 7F-7G.

8.3.3. 4-1BB Assays 8.3.3.1. 4-1BB NF-κB Reporter

HEK293 cells previously transduced with the pLenti-NFκB-Luciferase vector was transfected with a plasmid expressing the human, cynomolgus, or mouse 4-1BB proteins using Lipofectamine 2000 (Invitrogen, Grand Island, N.Y., USA). Activation of 4-1BB on the surface of reporter cells triggers a signaling cascade leading to the activation of NF-κB and the subsequent expression of luciferase. Cells were thawed, resuspended at $5\times10^5$ cells/mL, and directly plated into 96 well format white/clear bottom plates (Thermo Fisher) at 50 µL/well (25,000 cells per well). A dose titration of purified antibody preparations were added in duplicate at 30, 10, 3.33, 1.11, 0.37, or 0.12 µg/mL at 50 µL/well. Crosslinkers were added in duplicate at 120, 40, 13.33, 4.44, 1.48, or 0.49 µg/mL or media at 50 µL/well. The following reagents were used as crosslinkers: Goat anti-mouse IgG Fc (Jackson Immunochemicals), Goat anti-human IgG Fc (Jackson Immunochemicals), or Goat anti-rat IgG Fc (Jackson Immunochemicals). Recombinant human (Abbvie, 6 µg/mL) or mouse 4-1BB Ligand (R&D, 6 µg/mL), TNFα (R&D, 60 ng/mL) or growth media were add to control wells for maximum and minimum luciferase activities for each of the cell lines. Assay plates were incubated overnight at 37° C. and luciferase activity was measured by relative luminescence (RLU) of the BriteLite Substrate (Perkin Elmer) at 75 µL/well. Data was plotted as percent ligand activity as follows:

% Relative activity=((RLU of sample−RLU of media)/(RLU of Ligand−RLU of media))×100.

8.3.3.2. 4-1BB FACS Binding

To determine species specificity and relative binding affinities of the test antibodies, cell lines were generated to exogenously express 4-1BB on the membrane. HEK293 cells were transfected with a plasmid expressing the human, cynomolgus, or mouse 4-1BB proteins. Stable, high expressing populations were sorted on the MoFlo sorter (Beckman) and maintained in DMEM, 10% fetal bovine serum, containing 500 µg/mL G418. For the assay, cells were dissociated with trypsin, resuspended at $5\times10^6$ cells/mL and transferred to the 500 µL polypropylene plate (Nunc) at 50 µL/well (250,000 cells/well). Test antibodies were added to appropriate wells of the assay plate at 20, 10, 5, 2.5, 1.25, 0.625, 0.312, 0.156, 0.078, 0.039, 0.0195, 0.00976 µg/mL (50 µL/well, singlets) and incubated at room temperature for 20 minutes. Cells were washed twice with 250 µL/PBS (Hyclone) per well. PE-labelled detection antibodies were added at 1:250 dilution of stock, 50 µL/well, and incubated for 20 minutes at room temperature. The following detection antibodies were used: Goat anti-Rat IgG-PE (Southern Biotech), Goat anti-Mouse IgG-PE (Southern Biotech) or Goat anti-Human IgG-PE (Southern Biotech). Cells were washed once and fixed with PBS containing 1% Formaldehyde. Plate was analyzed for fluorescence on the FACSCalibur (Becton Dickinson).

8.3.3.3. 4-1BB Ligand Competition

To evaluate the ability of the anti-4-1BB antibodies to compete with the 4-1BB ligand (4-1BBL) for binding, an ELISA assay was developed Immunlon 4 plates (Dynatec) were coated with Goat anti-human IgG Fc specific at 0.5 µg/mL (Jackson Immunochemicals) in Carbonate-Bicarbonate buffer (Pierce), overnight at room temperature. Plates were washed and either mouse (R&D Systems) or human 4-1BB-Fc (R&D Systems) proteins were added at 0.2 µg/mL and incubated for 1 hour at room temperature. Plates were washed and the test antibodies were added as follows: 10, 5, 2.5, 1.25, 0.625, 0.3125, 0.156, 0.078, 0.039, 0.0195, 0.00976, or 0 µg/mL in duplicate and incubated for 1 hour at room temperature. Solution was then removed from the wells. Either human 4-1BBL (SEQ ID NO:274) (R&D Systems, at 0.02 µg/mL) or mouse 4-1BBL (R&D Systems, at 0.04 µg/mL) was added to respective wells and incubated for 1 hour at room temperature. Plates were washed and either biotinylated anti-human 4-1BBL (R&D Systems) or biotinylated anti-mouse 4-1BBL (R&D Systems) reagents were added at 0.05 µg/mL to detect the presence of 4-1BBL in the assay plates. Plates were washed and the complex was detected with Avidin-HRP (Jackson Immunochemicals) at 1:5000 dilution, incubated for 30 minutes at room temperature. Plates were washed and TMB Substrate (BioFx) was added to each well 100 µL/well. After 5 minutes of incubation, TMB Stop buffer (BioFx) was added at 50 µL/well.

Plates were read at 650 nM on the Spectramax (Molecular Devices). Data was plotted as Percent Maximum (4-1BBL) binding as follows:

% Max Binding=(OD$_{650}$ of sample)/(OD$_{650}$ at 0 µg/mL antibody)×100.

8.3.3.4. CD8+ T Cell Assay with Crosslinker

Human PBMC was purified from buffy coat by Ficoll-paque centrifugation and the CD8+ T cells were then purified from the PBMC using CD8+ T cells negative selection kit (StemCell Technologies). CD8+ T cells were resuspended in AIM-V medium. Antibodies were also prepared in this medium. A 96-well flat bottom plate was coated with 100 µL of 0.5 µg/mL OKT3 in PBS for 2 hr in the incubator, and the plate was washed twice with AIM-V. To the plate was added 50 µL CD8+ T cells (2×10$^5$) per well, with 50 µL 4-1BB antibody (30 µg/mL or desired concentration gradient), and 50 µL goat anti-human IgG, Fcγ specific antibody (120 µg/mL or 4 times the amount of 4-1BB antibody used). The plates were incubated for 72 hr, after which 50 µL supernatant was taken for cytokine analysis by LUMINEX®. To the plate was added 50 µL AIM-V/0.5 µCi $^3$H per well and the mixtures incubated for 6 hr to measure thymidine incorporation (proliferation).

Alternatively, with CHOK1-FcγR transfectants or PC3-MSLN as crosslinker, irradiated cells (2×10$^4$/well) were placed in a 96-well plate in complete medium the day before experiment. CD8+ T cells and antibody gradient were prepared in AIM-V medium. The medium in the wells was replaced with 100 µL CD8+ T cells (2×10$^5$/well) and 100 µL 4-1BB antibody containing 1 µg/mL OKT3. The plates were incubated, and analysis for cytokine release and proliferation was performed as above.

8.3.4. Binding Data of Rat Anti-4-1BB Antibodies

Exemplary antibodies to 4-1BB were generated, and the amino acid sequences for the corresponding V$_H$ and V$_L$ sequences are shown in FIGS. 7A-7C.

The rat antibodies TABBY101 through TABBY108 all exhibited binding to murine 4-1BB as demonstrated by surface plasmon resonance (Biacore) as shown in Table 3-1.

TABLE 3-1

Binding of rat antibodies to murine 4-1BB by Biacore

| Antibody | Light chain | mu4-1BB K$_D$ (nM) |
|---|---|---|
| TABBY101-rIgG$_1$ | kappa | 0.82 |
| TABBY102-rIgG$_1$ | kappa | 0.84 |
| TABBY103-rIgG$_1$ | kappa | 0.17 |
| TABBY104-rIgG$_1$ | kappa | 0.14 |
| TABBY105-rIgG$_{2a}$ | kappa | 15 |
| TABBY106-rIgG$_1$ | lambda | 1.6 |
| TABBY107-rIgG$_1$ | kappa | 6.7 |
| TABBY108-rIgG$_1$ | kappa | 0.36 |

Additionally, the murine antibodies TABBY1.1 through TABBY10 exhibited binding to human 4-1BB by Biacore as shown in Table 3-2.

TABLE 3-2

Binding of murine antibodies to human 4-1BB by Biacore

| Antibody | hu4-1BB K$_D$ (nM) |
|---|---|
| TABBY1.1-mIgG$_1$ | 2.0 |
| TABBY3-mIgG$_{2b}$ | 6.6 |
| TABBY5-mIgG$_{2b}$ | 0.3 |
| TABBY6-mIgG$_1$ | 1.9 |
| TABBY10-mIgG$_1$ | 3.1 |

Binding of exemplary antibodies to endogenous human 4-1BB, as well as their respective EC$_{50}$s, was determined by surface plasmon resonance analysis in an analogous manner as described in Example 1. Table 3-3 shows that the 4-1BB antibodies TABBY106-rIgG$_1$ and TABBY107-rIgG$_1$ (i.e., with rat IgG$_1$ constant regions and with lambda and kappa light chains, respectively) exhibited a different binding profile than literature 4-1BB antibodies 3H3 and 1D8. In contrast to 3H3 and 1D8, the presently disclosed antibodies showed binding to human 4-1BB. Further, 4-1BB antibodies TABBY106-rIgG$_1$ and TABBY107-rIgG$_1$ bound to murine 4-1BB.

TABLE 3-3

Binding kinetics of exemplary antibodies to human and mouse 4-1BB*

| | Human 4-1BB | | | Mouse 4-1BB | | |
|---|---|---|---|---|---|---|
| Protein | k$_a$ (1/M-s) | k$_d$ (1/s) | K$_D$ (M) | k$_a$ (1/M-s) | k$_d$ (1/s) | K$_D$ (M) |
| 3H3 | Not detected | | | 5.8E+06 | 5.7E−03 | 9.8E−10 |
| 1D8 | Not detected | | | 2.1E+06 | 8.0E−03 | 3.9E−09 |
| TABBY106-rIgG$_1$ | 2.2E+06 | 2.6E−02 | 1.2E−08 | 8.1E+06 | 1.3E−02 | 1.6E−09 |
| TABBY107-rIgG$_1$ | 4.5E+05 | 1.4E−04 | 3.2E−10 | 2.4E+05 | 1.6E−03 | 6.7E−09 |

*Values refer to exponential notation, e.g., 3.0E−09 = 3.0 × 10$^{-9}$.

Additionally, the exemplary 4-1BB murine antibodies TABBY106-rIgG$_1$ and TABBY107-rIgG$_1$ also bind to cynomolgus 4-1BB in contrast to the literature 4-1BB antibodies 3H3 and 1D8. The results are summarized in Table 3-4.

TABLE 3-4

Binding kinetics of exemplary antibodies to cynomolgus 4-1BB*

| Protein | Cynomolgus 4-1BB | | |
|---|---|---|---|
| | $k_a$ (1/M-s) | $k_d$ (1/s) | $K_D$ (M) |
| 3H3 | | Not detected | |
| 1D8 | | Not detected | |
| TABBY106-rIgG$_1$ | 1.2E+06 | 2.2E−02 | 1.8E−08 |
| TABBY107-rIgG$_1$ | 3.5E+05 | 1.3E−04 | 3.6E−10 |

*Values refer to exponential notation, e.g., 3.0E−09 = 3.0 × 10$^{-9}$.

The rat antibodies TABBY101 through TABBY108 were tested for competitive binding with human 4-1BB ligand against human 4-1BB according to the Biacore assay described above. None of the antibodies competed with human 4-1BB ligand for binding to human 4-1BB.

Example 4—Design and In Vitro Evaluation of Bispecific Binding Proteins Binding CD40 and Mesothelin 8.4.1. Rationale and Molecular Design A tumor targeting anti-CD40 binding protein should ideally activate CD40 upon binding to tumor antigen that is on the membrane of tumor cells. The tumor antigen binding may provide crosslinking for activating CD40 multimerization and initiating downstream signaling. Such a binding protein should exhibit minimal CD40 agonistic activity when no tumor antigen is present. Upon binding cell surface tumor antigen, the binding protein would increase CD40 agonist activity. To this end, different bispecific binding protein formats were tested.

One format was the dual variable domain immunoglobulin (DVD-Ig) (FIG. 2A), which contained two variable (V) domains in tandem, connected by a linker, followed by the constant regions of a conventional antibody. To construct CD40/tumor antigen DVD-Igs, the V-domain against a tumor antigen was placed in the outer domain, at the amino (N)-terminus of the molecule, while the V-domain against CD40 was placed in the inner domain. The two V-domains on the heavy (V$_H$) chain and light (V$_L$) chains in the DVD-Ig were linked by GS linkers, i.e., GGGGSGGGGS (SEQ ID NO:346) for V$_H$ and GGSGGGGSG (SEQ ID NO:347) for V$_L$, or long (L) or short (S) linkers, designed based on the hinge regions naturally occurring in antibodies (Wu, C et. al., Nature Biotechnology, 25: 1290-1297 (2007)). The linkers have been previously described (e.g., in Jakob, et al. mAbs, 5(3): 358-363 (2013)). The heavy chain long linker has the amino acid sequence ASTKGPSVFPLAP (SEQ ID NO:342), and the short linker has the sequence ASTKGP (SEQ ID NO:343). For the light chain, the long linker has an amino acid sequence TVAAPSVFIFPP (SEQ ID NO:344), and the short linker has a sequence TVAAP (SEQ ID NO:345). Hence, the DVD proteins may be described with the linker combinations of the variable heavy chains and variable light chains, e.g., "LS" comprises a variable heavy "long" chain linker and a variable light "short" chain linker.

Accordingly, a panel of DVD binding proteins, each with a different linker combination, DVD-LL, DVD-LS, DVD-SL, DVD-SS, DVD-GS, were generated on the human IgG$_2$ or human IgG$_1$ V273E constant regions with the anti-CD40 domains with V$_H$ and V$_L$ adapted from huAb8-1 or huAb9-5, and anti-MSLN domains with V$_H$ and V$_L$ adapted from the anti-MSLN antibody HuAM15.

CO-DVD bispecific proteins according the structure of FIG. 2B were also constructed according to the PCT publication (WO 2013/101972, for a discussion of CO-DVD).

A third bispecific format tested was the bispecific binding protein of formula (I) shown in FIG. 1A. In this format, antibody variable domains were represented by a single chain Fv (scFv) (an antigen binding domain where the V$_H$ and V$_L$ domains were connected by a flexible linker). One scFv was located at the N-terminus of the molecule and was followed by the hinge, CH2 region, and CH3 region of an IgG constant region. A second scFv was placed at the C-terminus, with a linker (SEQ ID NO:251) connecting the CH3 region and scFv. The scFv's against CD40 and the tumor antigen were placed at either the N- or C-terminus.

Bispecific binding proteins of formula (I) were generated with CD40 scFv at either the amino (N-) or carboxyl (C-) terminus of the human IgG$_2$, human IgG$_1$ V273E or V273Y constant regions (TABLE 4-1). The amino acid sequences of the binding proteins in TABLE 4-1 are shown in FIG. 8A-8G.

TABLE 4-1

Bispecific proteins of formula (I) binding CD40 and mesothelin

| Protein | N-terminal domain | C-terminal domain | Linker | Isotype | Identifier |
|---|---|---|---|---|---|
| h24 | HuAb17 (V$_H$-V$_L$) | huAb6-1 (V$_H$→V$_L$) | SEQ ID NO: 251 | huIgG$_1$ V273Y | SEQ ID NO: 401 |
| h26 | HuAb17 (V$_H$-V$_L$) | huAb6-1 (V$_L$→V$_H$) | SEQ ID NO: 251 | huIgG$_1$ V273Y | SEQ ID NO: 402 |
| B37 | huAb8-1 (V$_H$-V$_L$) | HuAM15 (V$_L$-V$_H$) | SEQ ID NO: 251 | huIgG$_1$ V273E | SEQ ID NO: 403 |
| B38 | huAb8-1 (V$_L$-V$_H$) | HuAM15 (V$_L$-V$_H$) | SEQ ID NO: 251 | huIgG$_1$ V273E | SEQ ID NO: 404 |
| B39 | huAb9-5 (V$_H$-V$_L$)) | HuAM15 (V$_H$-V$_L$) | SEQ ID NO: 251 | huIgG$_2$ | SEQ ID NO: 405 |
| B40 | huAb9-5 (V$_H$-V$_L$) | HuAM15 (V$_L$-V$_H$) | SEQ ID NO: 251 | huIgG$_1$ V273E | SEQ ID NO: 406 |
| B41 | huAb9-5 (V$_L$-V$_H$) | HuAM15 (V$_H$-V$_L$) | SEQ ID NO: 251 | huIgG$_1$ V273E | SEQ ID NO: 407 |
| B42 | huAb9-5 (V$_L$-V$_H$) | HuAM15 (V$_L$-V$_H$) | SEQ ID NO: 251 | huIgG$_1$ V273E | SEQ ID NO: 408 |
| B43 | HuAM15 (V$_H$-V$_L$) | huAb8-1 (V$_L$-V$_H$) | SEQ ID NO: 251 | huIgG$_1$ V273E | SEQ ID NO: 409 |
| B44 | HuAM15 (V$_L$-V$_H$) | huAb8-1 (V$_H$-V$_L$) | SEQ ID NO: 251 | huIgG$_1$ V273E | SEQ ID NO: 410 |
| B45 | HuAM15 (V$_L$-V$_H$) | huAb8-1 (V$_L$-V$_H$) | SEQ ID NO: 251 | huIgG$_1$ V273E | SEQ ID NO: 411 |
| B46 | HuAM15 (V$_L$-V$_H$) | huAb9-5 (V$_H$-V$_L$) | SEQ ID NO: 251 | huIgG$_1$ V273E | SEQ ID NO: 412 |

8.4.2. Evaluation of Mesothelin-Dependent Activity of CD40 Bispecific Binding Proteins The molecules with conditional activation were designed to be selectively active in the presence of mesothelin with lower or minimal activity in its absence. For purposes of this example, the activity in the presence of mesothelin should exhibit at least five-fold enhancement in potency as well as in magnitude compared to that in the absence of mesothelin.

To identify molecules with mesothelin-dependent conditional activity, the bispecific binding proteins in different formats were first tested for binding to CD40 and MSLN targets. Subsequently CD40/mesothelin bispecific binding proteins were assessed for their ability to activate B cells and dendritic cells when co-cultured with mesothelin-expressing HEK293 cells or parental 293 cells without mesothelin expression. As described above, B cell activation was monitored by B cell proliferation, and DC activation was monitored by IL-12p70 production. In addition, cell surface activation maker, such as CD23, CD83 and CD86, were also monitored by flow cytometry on B cells as well as on DC. In these experiments, anti-CD40 antibodies were used as positive control, and an isotype matched hIgG as negative control.

The DVD-Ig bispecific proteins DVD-LL, DVD-LS, DVD-SL, DVD-SS, and DVD-GS constructed as discussed above were first tested for binding to CD40 or MSLN, and demonstrated binding affinity in binding assays. The DVD-Ig molecules were tested for in vitro immune cell activation in the presence or absence of mesothelin-positive cells. None of the DVD-Ig proteins showed mesothelin-dependent B cell or dendritic cells activation. In the presence of mesothelin, these molecules had little to no activity.

Exemplary CO-DVD bispecific proteins were constructed with variable domains specific for CD40 and mesothelin as discussed above, but did not exhibit significant anti-mesothelin binding.

Figure 9A:
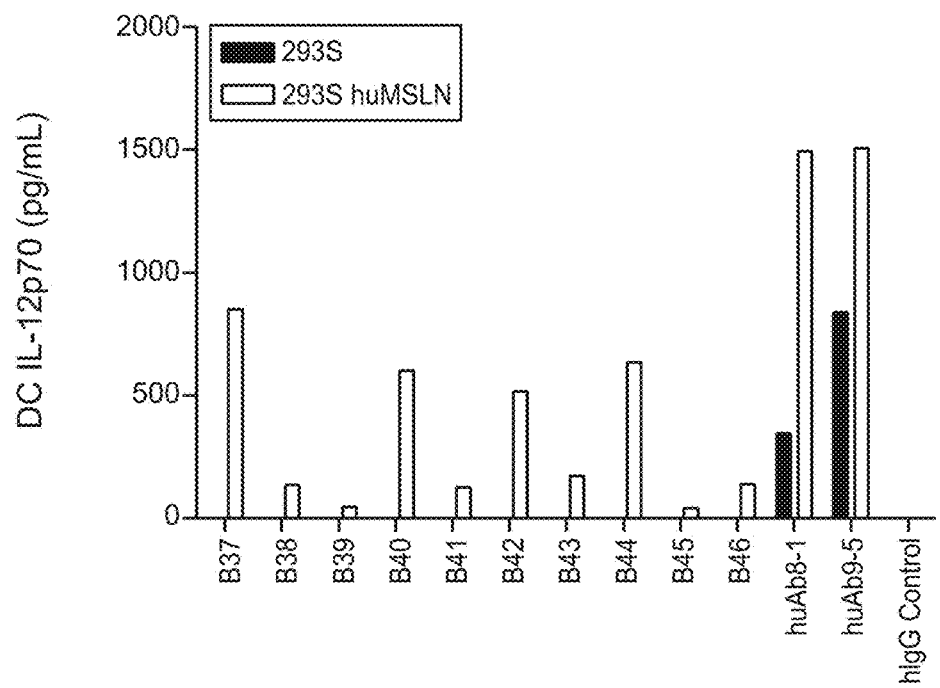
Figure 9B:
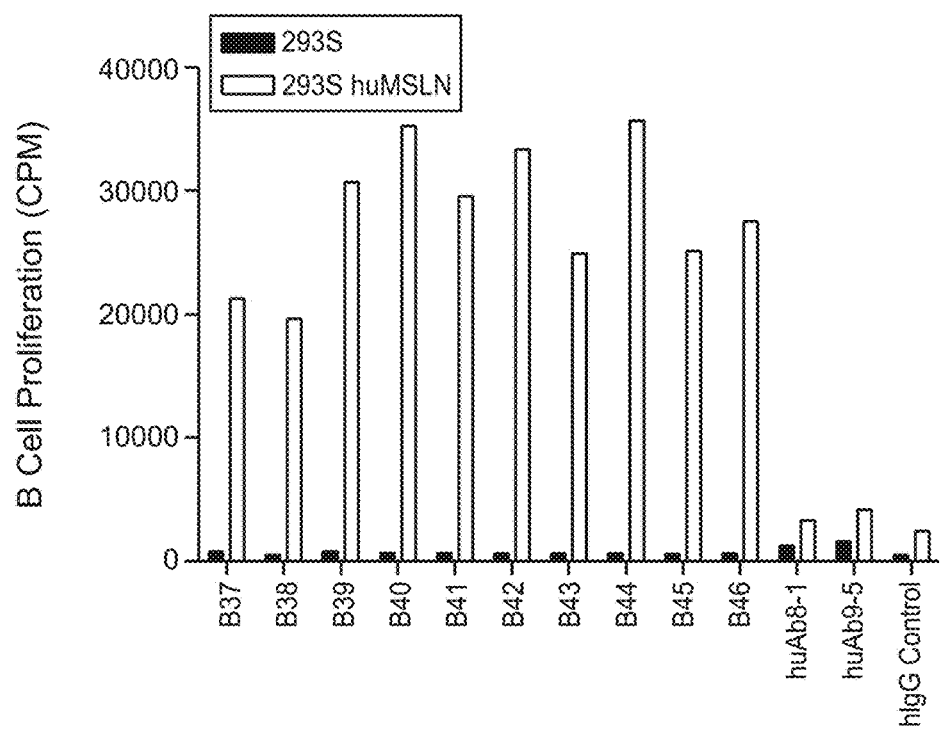

Several bispecific binding proteins of formula (I) described in TABLE 4-1 demonstrated binding to both CD40 and MSLN (TABLE 4-2), and were evaluated for their ability to exhibit MSLN-dependent CD40 activation of DCs and B cells. The bispecific proteins of formula (I) stimulated little to no IL-12p70 release from DCs co-cultured with HEK293 cells without mesothelin, while the same proteins stimulated significant IL-12p70 release from DC co-cultures with HEK293 cells expressing mesothelin (FIG. 9A). Similarly, the bispecific binding proteins of formula (I) exhibited minimal activity in stimulating B cell proliferation as gauged by negative control human IgG when B cells were co-cultured with HEK293 parental cells. When co-cultured with HEK293 cells expressing mesothelin, the formula (I) proteins stimulated significant proliferation of B cells as compared with anti-CD40 antibody huAb8-1 or huAb9-5 (FIG. 9B).

TABLE 4-2

Antigen binding of bispecific binding proteins of formula (I)

| Protein | MSLN binding $EC_{50}$ (µg/mL) | CB40 binding $EC_{50}$ (µg/mL) |
|---|---|---|
| B37 | 4.4 | 0.5 |
| B38 | 14.3 | 1.2 |
| B39 | 7.4 | 0.5 |
| B40 | 9.0 | 0.4 |
| B41 | 11.9 | 0.5 |
| B42 | 6.0 | 0.8 |

TABLE 4-2-continued

Antigen binding of bispecific binding proteins of formula (I)

| Protein | MSLN binding $EC_{50}$ (µg/mL) | CB40 binding $EC_{50}$ (µg/mL) |
|---|---|---|
| B43 | 7.3 | 3.3 |
| B44 | 5.7 | 0.8 |
| B45 | 5.6 | 1.2 |
| B46 | 2.5 | 0.5 |
| HuAM15 | 0.9 | — |
| huAb8-1 | — | 0.4 |
| huAb9-5 | — | 0.2 |

A summary of the activation enhancement of an exemplary bispecific binding protein of formula (I), B40 (SEQ ID NO:406), in immune cells in vitro is shown in Table 4-3. Upon binding to cell surface MSLN, B40 induced B-cell activation as measured by induction of activation markers (CD23 and CD86) and B cell proliferation, and induced monocyte-derived dendritic cell (moDC) activation, as measured by interleukin (IL)-12 p70 and CD83 expression. In the absence of MSLN, B40 was significantly less potent in inducing B-cell activation and had no detectable effect on moDCs compared to the agonistic anti-CD40 antibody huAb9 A2I. As seen in the B-cell assays, for example, with the CD86 assay readout, bispecific binding protein B40 showed a reduction of $EC_{50}$ going from B-cells in the absence of mesothelin ("-MSLN") (mesothelin $EC_{50}$=1.4 nM) to B-cells co-cultured with HEK293 cells expressing cell-surface mesothelin ("+ MSLN") (mesothelin $EC_{50}$=0.035 nM). Similarly, in monocyte-derived dendritic cells ("moDC"), with either assay readout, mesothelin $EC_{50}$ went from undetectable (i.e., no measured activity) in the absence of mesothelin to subnanomolar potency [$EC_{50}$=0.15 nM (CD83) and $EC_{50}$=0.44 nM (IL-12p70)] in the presence of HEK293 cells expressing mesothelin.

TABLE 4-3

Immune cell activation data for anti-CD40 antibody huAb9 A2I and bispecific binding protein B40

| | | −MSLN ($EC_{50}$, nM) | | +MSLN ($EC_{50}$, nM) | |
|---|---|---|---|---|---|
| Agonistic assay | Assay readout | huAb9 A2I | B40 | huAb9 A2I | B40 |
| B-cell (n = 3) | CD86 | 0.35 ± 0.13 | 1.4 ± 0.4 | 0.70 ± 0.36 | 0.035 ± 0.012 |
| | CD23 | 1.4 ± 0.9 | 10 ± 3 | 2.5 ± 0.7 | 0.12 ± 0.03 |
| | proliferation | 4.5 ± 1.5 | 22 ± 10 | 12 ± 4 | 0.33 ± 0.25 |
| | CD40 Occupancy | 4.1 ± 1.1 | 5.0 ± 1.3 | Not determined | Not determined |
| moDC (n = 3) | CD83 | 2.0 ± 0.5 | Not detectable | 6.9 ± 5.0 | 0.15 ± 0.04 |
| | IL-12p70 | 12.4 ± 6.5 | Not detectable | 3.4 ± 0.58 | 0.44 ± 0.02 |

Further exemplary bispecific binding proteins of formula (I) were constructed and evaluated. The variable domain structures of the proteins are given in Table 4-4. Exemplary proteins V6-2 (SEQ ID NO:419), V6-5 (SEQ ID NO:420) and V6-6 (SEQ ID NO:421) had full length amino acid sequences as shown in FIGS. 8G-8H. Additionally, the sequences for each of the two polypeptides composing proteins V6-3, V6-7, V6-11, and V6-14 were the amino acid sequences according to SEQ ID NOS: 422-425, respectively. In the illustrated examples, $scFv^X$ and $scFv^Y$ had the variable chain orientation (in N→C direction) as shown, and the linker between the constant region to $scFv^Y$ in each case was SEQ ID NO:262. In addition, the CH2 constant domains were $IgG_1$ variants having either the V263L or V273E substitution.

TABLE 4-4

Additional exemplary bispecific proteins of formula (I) binding CD40 and mesothelin

| Protein | scFv$^X$V$_H$ | scFv$^X$V$_L$ | CH2 | scFv$^Y$V$_H$ | scFv$^Y$V$_L$ |
|---|---|---|---|---|---|
| V5-2 | SEQ ID NO: 17 (V$_H$→V$_L$) | SEQ ID NO: 44 (V$_H$→V$_L$) | IgG$_1$ V263L | SEQ ID NO: 120 (V$_L$→V$_H$) | SEQ ID NO: 137 (V$_L$→V$_H$) |
| V6-1 | SEQ ID NO: 17 (V$_H$→V$_L$) | SEQ ID NO: 44 (V$_H$→V$_L$) | IgG$_1$ V273E | SEQ ID NO: 120 (V$_L$→V$_H$) | SEQ ID NO: 141 (V$_L$→V$_H$) |
| V6-2 | SEQ ID NO: 17 (V$_H$→V$_L$) | SEQ ID NO: 44 (V$_H$→V$_L$) | IgG$_1$ V263L | SEQ ID NO: 120 (V$_L$→V$_H$) | SEQ ID NO: 141 (V$_L$→V$_H$) |
| V6-3 | SEQ ID NO: 17 (V$_H$→V$_L$) | SEQ ID NO: 49 (V$_H$→V$_L$) | IgG$_1$ V273E | SEQ ID NO: 120 (V$_L$→V$_H$) | SEQ ID NO: 137 (V$_L$→V$_H$) |
| V6-4 | SEQ ID NO: 17 (V$_H$→V$_L$) | SEQ ID NO: 49 (V$_H$→V$_L$) | IgG$_1$ V263L | SEQ ID NO: 120 (V$_L$→V$_H$) | SEQ ID NO: 137 (V$_L$→V$_H$) |
| V6-5 | SEQ ID NO: 17 (V$_H$→V$_L$) | SEQ ID NO: 49 (V$_H$→V$_L$) | IgG$_1$ V273E | SEQ ID NO: 120 (V$_L$→V$_H$) | SEQ ID NO: 141 (V$_L$→V$_H$) |
| V6-6 | SEQ ID NO: 17 (V$_H$→V$_L$) | SEQ ID NO: 49 (V$_H$→V$_L$) | IgG$_1$ V263L | SEQ ID NO: 120 (V$_L$→V$_H$) | SEQ ID NO: 141 (V$_L$→V$_H$) |
| V6-7 | SEQ ID NO: 17 (V$_H$→V$_L$) | SEQ ID NO: 49 (V$_H$→V$_L$) | IgG$_1$ V273E | SEQ ID NO: 129 (V$_H$→V$_L$) | SEQ ID NO: 143 (V$_H$→V$_L$) |
| V6-8 | SEQ ID NO: 17 (V$_H$→V$_L$) | SEQ ID NO: 49 (V$_H$→V$_L$) | IgG$_1$ V263L | SEQ ID NO: 129 (V$_H$→V$_L$) | SEQ ID NO: 143 (V$_H$→V$_L$) |
| V6-9 | SEQ ID NO: 17 (V$_H$→V$_L$) | SEQ ID NO: 49 (V$_H$→V$_L$) | IgG$_1$ V273E | SEQ ID NO: 129 (V$_L$→V$_H$) | SEQ ID NO: 143 (V$_L$→V$_H$) |
| V6-10 | SEQ ID NO: 17 (V$_H$→V$_L$) | SEQ ID NO: 49 (V$_H$→V$_L$) | IgG$_1$ V263L | SEQ ID NO: 129 (V$_L$→V$_H$) | SEQ ID NO: 143 (V$_L$→V$_H$) |
| V6-11 | SEQ ID NO: 129 (V$_L$→V$_H$) | SEQ ID NO: 143 (V$_L$→V$_H$) | IgG$_1$ V273E | SEQ ID NO: 17 (V$_H$→V$_L$) | SEQ ID NO: 49 (V$_H$→V$_L$) |
| V6-12 | SEQ ID NO: 129 (V$_L$→V$_H$) | SEQ ID NO: 143 (V$_L$→V$_H$) | IgG$_1$ V263L | SEQ ID NO: 17 (V$_H$→V$_L$) | SEQ ID NO: 49 (V$_H$→V$_L$) |
| V6-13 | SEQ ID NO: 129 (V$_H$→V$_L$) | SEQ ID NO: 143 (V$_H$→V$_L$) | IgG$_1$ V263L | SEQ ID NO: 17 (V$_H$→V$_L$) | SEQ ID NO: 49 (V$_H$→V$_L$) |
| V6-14 | SEQ ID NO: 120 (V$_L$→V$_H$) | SEQ ID NO: 141 (V$_L$→V$_H$) | IgG$_1$ V273E | SEQ ID NO: 17 (V$_H$→V$_L$) | SEQ ID NO: 49 (V$_H$→V$_L$) |
| V6-15 | SEQ ID NO: 23 (V$_H$→V$_L$) | SEQ ID NO: 49 (V$_H$→V$_L$) | IgG$_1$ V273E | SEQ ID NO: 129 (V$_L$→V$_H$) | SEQ ID NO: 143 (V$_L$→V$_H$) |
| V6-16 | SEQ ID NO: 23 (V$_H$→V$_L$) | SEQ ID NO: 49 (V$_H$→V$_L$) | IgG$_1$ V263L | SEQ ID NO: 129 (V$_L$→V$_H$) | SEQ ID NO: 143 (V$_L$→V$_H$) |

Binding data for the exemplary bispecific proteins binding mesothelin and CD40 were determined by surface plasmon resonance as shown in Table 4-5 and Table 4-6. Binding proteins V5-3, V6-6, and V6-8 demonstrated binding to CD40 and mesothelin derived from humans or cynomolgus monkeys.

The results of conditional activation of CD40 by the exemplary bispecific proteins of formula (I) in the dendritic cell assay described in Example 1, co-cultured with HEK293 cells expressing cell-surface mesothelin, are shown in Table 4-7. Bispecific binding proteins V6-2, V6-5, and

TABLE 4-5

Exemplary bispecific protein binding human CD40 and mesothelin*

| | Human CD40 | | | Human MSLN | | |
|---|---|---|---|---|---|---|
| Protein | k$_a$(1/M-s) | k$_d$ (1/s) | K$_D$ (M) | k$_a$(1/M-s) | k$_d$ (1/s) | K$_D$ (M) |
| V5-2 | 1.7E+06 | 2.5E−01 | 1.5E−07 | 1.4E+04 | 2.8E−05 | 2.0E−09 |
| V6-6 | 1.1E+06 | 1.4E−02 | 1.3E−08 | 1.3E+04 | 3.0E−05 | 2.4E−09 |
| V6-8 | 9.7E+05 | 1.4E−02 | 1.4E−08 | 1.3E+05 | 1.5E−03 | 1.1E−08 |

*Values refer to exponential notation, e.g., 3.0E−09 = 3.0 × 10$^{-9}$.

TABLE 4-6

Exemplary bispecific protein binding cynomolgus CD40 and mesothelin*

| | cynoCD40 | | | cynoMSLN | | |
|---|---|---|---|---|---|---|
| Protein | k$_a$(1/M-s) | k$_d$ (1/s) | K$_D$ (M) | k$_a$(1/M-s) | k$_d$ (1/s) | K$_D$ (M) |
| V5-2 | 9.4E+05 | 1.1E−01 | 1.2E−07 | 7.0E+04 | 5.9E−05 | 8.4E−10 |
| V6-6 | 1.4E+06 | 1.3E−02 | 9.5E−09 | 6.1E+04 | 5.3E−05 | 8.7E−10 |
| V6-8 | 1.3E+06 | 1.3E−02 | 1.1E−08 | Fast kinetics | | 1.3E−06 |

*Values refer to exponential notation, e.g., 3.0E−09 = 3.0 × 10$^{-9}$.

V6-6 demonstrated activation of dendritic cells in the presence of mesothelin as measured by production of IL-12p70.

TABLE 4-7

Dendritic cell activation of CD40 by bispecific proteins in presence of mesothelin

| Protein | Max. IL-12p70 (pg/mL) |
|---|---|
| V6-2 | 150 |
| V6-5 | 300 |
| V6-6 | 300 |

8.4.3. Design and Generation of Bispecific Binding Proteins Having a Fab and an scFv Region Exemplary bispecific binding proteins of formula (I) similar to the format illustrated in FIG. 1B, having a Fab region and an scFv region, were prepared and evaluated (Table 4-8). The Fab regions were derived from mesothelin antibodies HuAM15 (proteins CF1 through CF10) and MSLN76923 (proteins CF11 through CF20). Both CH2 constant region variants V273E and V263L were prepared. In all cases, the orientation of the scFv regions derived from a CD40 antibody was $V_H \rightarrow V_L$ (in N→C direction), and the linker between the Fc region to the scFv was SEQ ID NO: 262. Accordingly, the heavy chains for proteins CF1 through CF20 shown in Table 4-8 below comprised the amino acid sequences according to SEQ ID NOS: 351 through 370, respectively. The corresponding light chains for CF1 through CF10 comprised the sequence according to SEQ ID NO: 371, and for CF11 through CF20 the sequence according to SEQ ID NO: 372.

TABLE 4-8

Bispecific binding proteins of formula (I) with a Fab region and an scFv region

| Protein | Fab region $V_H, V_L$ | CH2 domain | scFv $V_H$ Identifier | scFv $V_L$ Identifier |
|---|---|---|---|---|
| CF1 | HuAM15 | IgG$_1$-V273E | SEQ ID NO: 17 | SEQ ID NO: 44 |
| CF2 | HuAM15 | IgG$_1$-V263L | SEQ ID NO: 17 | SEQ ID NO: 44 |
| CF3 | HuAM15 | IgG$_1$-V273E | SEQ ID NO: 22 | SEQ ID NO: 48 |
| CF4 | HuAM15 | IgG$_1$-V263L | SEQ ID NO: 22 | SEQ ID NO: 48 |
| CF5 | HuAM15 | IgG$_1$-V273E | SEQ ID NO: 22 | SEQ ID NO: 49 |
| CF6 | HuAM15 | IgG$_1$-V263L | SEQ ID NO: 22 | SEQ ID NO: 49 |
| CF7 | HuAM15 | IgG$_1$-V273E | SEQ ID NO: 23 | SEQ ID NO: 48 |
| CF8 | HuAM15 | IgG$_1$-V263L | SEQ ID NO: 23 | SEQ ID NO: 48 |
| CF9 | HuAM15 | IgG$_1$-V273E | SEQ ID NO: 23 | SEQ ID NO: 49 |
| CF10 | HuAM15 | IgG$_1$-V263L | SEQ ID NO: 23 | SEQ ID NO: 49 |
| CF11 | MSLN76923 | IgG$_1$-V273E | SEQ ID NO: 17 | SEQ ID NO: 44 |
| CF12 | MSLN76923 | IgG$_1$-V263L | SEQ ID NO: 17 | SEQ ID NO: 44 |
| CF13 | MSLN76923 | IgG$_1$-V273E | SEQ ID NO: 22 | SEQ ID NO: 48 |
| CF14 | MSLN76923 | IgG$_1$-V263L | SEQ ID NO: 22 | SEQ ID NO: 48 |
| CF15 | MSLN76923 | IgG$_1$-V273E | SEQ ID NO: 22 | SEQ ID NO: 49 |
| CF16 | MSLN76923 | IgG$_1$-V263L | SEQ ID NO: 22 | SEQ ID NO: 49 |
| CF17 | MSLN76923 | IgG$_1$-V273E | SEQ ID NO: 23 | SEQ ID NO: 48 |
| CF18 | MSLN76923 | IgG$_1$-V263L | SEQ ID NO: 23 | SEQ ID NO: 48 |
| CF19 | MSLN76923 | IgG$_1$-V273E | SEQ ID NO: 23 | SEQ ID NO: 49 |
| CF20 | MSLN76923 | IgG$_1$-V263L | SEQ ID NO: 23 | SEQ ID NO: 49 |

Exemplary binding data was determined using surface plasmon resonance for bispecific proteins having a Fab region binding mesothelin and an scFv region binding CD40. Data for human CD40 and human mesothelin are shown in Table 4-9, and for cynomolgus CD40 and cynomolgus mesothelin in Table 4-10. Proteins CF1, CF3, and CF19 afford significant binding affinity for both human CD40 and human mesothelin ($K_D$<4.0×10$^{-7}$M). The three proteins also provide significant binding to cynomolgus CD40 ($K_D$<1.5×10$^{-7}$M). Additionally, while the bispecific binding proteins derived from HuAM15 (CF1 and CF3) bound significantly to cynomolgus mesothelin ($K_D$≤2.9×10$^{-10}$ M), CF19 protein with the variable regions derived from antibody MSLN76923 did not bind cynomolgus mesothelin or only bound weakly.

TABLE 4-9

Binding of exemplary bispecific proteins to human CD40 and mesothelin*

| | Human CD40 | | | Human MSLN | | |
|---|---|---|---|---|---|---|
| Protein | $k_a$ (1/M-s) | $k_d$ (1/s) | $K_D$ (M) | $k_a$ (1/M-s) | $k_d$ (1/s) | $K_D$ (M) |
| CF1 | 6.8E+05 | 2.6E−01 | 3.9E−07 | 5.2E+04 | 2.4E−05 | 4.7E−10 |
| CF3 | 6.9E+05 | 9.6E−03 | 1.4E−08 | 5.2E+04 | 3.1E−05 | 5.9E−10 |
| CF19 | 4.3E+05 | 1.7E−02 | 4.0E−08 | 3.0E+05 | 8.1E−03 | 2.8E−08 |

*Values refer to exponential notation, e.g., 3.0E−09 = 3.0 × 10$^{-9}$.

TABLE 4-10

Binding of exemplary bispecific proteins to cynomolgus CD40 and mesothelin*

| Protein | Cyno CD40 | | | Cyno MSLN | | |
|---|---|---|---|---|---|---|
| | $k_a$(1/M-s) | $k_d$(1/s) | $K_D$(M) | $k_a$(1/M-s) | $k_d$(1/s) | $K_D$(M) |
| CF1 | Fast kinetics | | 1.5E−07 | 3.1E+05 | 7.1E−05 | 2.3E−10 |
| CF3 | 1.3E+06 | 1.1E−02 | 8.3E−09 | 2.8E+05 | 8.2E−05 | 2.9E−10 |
| CF19 | 8.1E+05 | 1.8E−02 | 2.2E−08 | Weak or no binding | | |

*Values refer to exponential notation, e.g., 3.0E−09 = 3.0 × 10$^{-9}$.

The exemplary bispecific binding proteins with a Fab region and an scFv region also exhibit conditional activation of CD40 in the presence of cell-surface mesothelin in dendritic cells. Table 4-11 summarizes the data obtained with these exemplary bispecific binding proteins with a mesothelin Fab region and a CD40 scFv region, that show mesothelin-dependent activation of dendritic cells. Bispecific binding proteins CF1, CF3, CF4, CF5, and CF9 demonstrate conditional activation of dendritic cells as measured by production of IL-12p70.

TABLE 4-11

Dendritic cell activity of bispecific proteins having a Fab and an scFv region

| Protein | Max. IL-12p70 (pg/mL) |
|---|---|
| CF1 | 100 |
| CF3 | 75 |
| CF4 | 50 |
| CF5 | 60 |
| CF9 | 120 |

Example 5—Production and Purification of an Exemplary CD40/Mesothelin Bispecific Binding Protein The following protocol is applicable to the production and purification of exemplary bispecific binding proteins of formula (I) binding CD40 and mesothelin as described herein, for example, any one of SEQ ID NOS: 401-412. A frozen vial of the cell bank is thawed, diluted with growth medium, and centrifuged to remove the cryopreservation medium. The cells are then re-suspended in fresh growth medium, GIA-1 (a chemically defined media from Life Technologies Gibco), supplemented with 6 mM glutamine (Gln). The cell suspension is cultured under 5% $CO_2$ at 36° C. The volume is adjusted by the addition of fresh medium at defined intervals in appropriately sized cell culture containers to sufficient biomass for the inoculation of a 110 L seed bioreactor. At a predetermined viable cell density, the culture from the seed bioreactor is used to inoculate the 3000 L short-fill bioreactor. In both the seed and the short-fill bioreactor, temperature and DO are controlled at set points of 36° C. and 40% respectively. Additionally, in both bioreactors, the pH set point of 6.9 is maintained through the addition of $CO_2$ or sodium hydroxide. The culture remains in the short-fill stage until a predetermined viable cell density is reached.

The production culture is performed in the 3000 L bioreactor as a fed-batch process. Production medium (GIA-1 supplemented with 6 mM Gln) is added to the short-fill culture to initiate the production stage. The temperature starts at the set point of 36° C. then shifts to 33° C. at the defined condition. DO is maintained at a set point of 40%. The pH set point of 6.9 is maintained through the addition of $CO_2$ or sodium hydroxide. Antifoam is added as needed for foam mitigation.

At a predetermined viable cell density, bolus additions of feed medium (1.5×JCL-5, a chemically defined feed medium from Life Technologies Gibco) are added to the bioreactor in predefined volumes according to a predefined feeding schedule. A 40% glucose feed solution is also added to the production bioreactor when the glucose concentration falls below predetermined concentrations. Harvest of the production bioreactor is initiated when the cell viability reaches ≤70% or 14 days after the start of the production bioreactor stage, whichever occurs first.

The crude cell culture harvest undergoes clarification, Protein A chromatography, viral inactivation, Q membrane filtration, and hydroxyapatite chromatography. The partially purified material is then further purified by nanofiltration, ultrafiltration, and diafiltration to afford a drug substance that is formulated by addition of pharmaceutical excipients. The drug substance is then bottled and stored.

The crude cell culture is cooled, and then pressure transferred through a continuous disc stack centrifuge. The centrate flows directly from the centrifuge into the depth filters and Sartorius Sartopore 2 polishing filters. After processing the culture fluid, the depth filters and final filters are flushed with buffered solution to collect the binding protein. The combined filtrate is collected, and is stored at from 2° C. to 12° C.

Protein A chromatography is achieved with a MabSelect SuRe column Prior to use, a post-storage rinse step is performed on the MabSelect SuRe column using equilibration buffer. The column is equilibrated and the chilled clarified harvest is loaded directly onto the column. A typical maximum column load per cycle is 40 g product per liter of resin. After loading, two washes are performed on the column, followed by elution with 50 mM acetic acid, pH 3.0. The collection of the elution starts and ends based on OD. Between cycles, the column is post elution washed and regenerated with equilibration buffer, and post regeneration washed with 0.2 M sodium hydroxide before equilibration for the next cycle.

The pH of the Protein A eluate is adjusted to 3.5±0.1 using phosphoric acid and held for 30 to 60 minutes. The viral inactivated Protein A eluate is neutralized with arginine and Tris. The material is then passed through Millipore XOHC filters and CR40 Activated carbon filters, in series, followed by Sartorius Sartopore 2 filter. Q Membrane filter is placed in-line following the Sartorius Sartopore 2 filter. A second Sartorius Sartopore 2 is placed in line following the Q Membrane. Following the completion of the load, the filters are flushed with ≥128 CV of Q membrane of buffer to recover any product remaining on the filters. The Q filtrate and wash is collected, and is held at from 2° C. to 25° C.

The CaPure hydroxyapatite column is operated in a bind-and-elute mode. The column is equilibrated with 10 mM sodium phosphate, pH 6.7 for 5 column volumes at 200 cm/hr linear flow rate. The Q filter flow-through pool comprising the bispecific binding protein is loaded directly onto the column at 100 cm/hr and at approximately 30 g/L capacity. After loading, the column is washed with 3 column volumes of the equilibration buffer, then eluted with elution buffer of 25 mM sodium phosphate, 114 mM sodium chloride, pH 6.7.

Nanofiltration is performed using Sartorius Sartopore 2 0.1 µm pre-filters, followed by Planova 20N viral filter. The filter train is rinsed with water for injection and 10 mM sodium phosphate, pH 6.7, prior to viral filtration of product. The hydroxyapatite column eluate is then pumped through the filter train, targeting 14 psig inlet pressures on the Planova filter.

The nanofiltrate is concentrated to a target concentration, followed by diafiltration with 30 kD Millipore Pellicon 3 Ultracel regenerated cellulose membranes performed at from 18° C. to 25° C. by 10 diavolumes of diafiltration buffer, 10 mM phosphate, pH 7.5. After diafiltration, the retentate is collected and the system is rinsed with the diafiltration buffer. The retentate is then diluted with excipient solution to a final formulation.

Example 6—Design and In Vitro Evaluation of Bispecific Binding Proteins of Formula (I) Binding CD40 and Other Tumor Antigens Binding domains to additional tumor antigens were evaluated for their ability to direct CD40 activation in a bispecific binding protein of formula (I). CD40/nectin-4, CD40/PSMA, and CD40/EGFR bispecific binding proteins were constructed using domains against the tumor antigens nectin-4 (clone 66.3), PSMA (clone SAM3.1) and EGFR (clone G30Y), respectively. In all cases, the CD40 domain in the bispecific molecules was adapted from the anti-human CD40 humanized antibody huAb6-1 (clone AD163.162.1) (TABLE 6-1). In all the examples, the CD40 domain is huAb6-1 in $V_H \rightarrow V_L$ direction, the linker linking the CH3 domain to the scFv comprises SEQ ID NO:251, and the constant regions are derived from human IgG$_1$ having the V273Y substitution. Orientation of the tumor antigen variable domains within the scFv are shown (in N→C direction). The amino acid sequences in TABLE 6-1 are shown in FIGS. 10B-10D.

TABLE 6-1

Bispecific proteins binding CD40 and tumor antigens

| Protein | Tumor domain | Clone | Tumor antigen Direction | Identifier |
|---|---|---|---|---|
| R87 | Nectin-4 | 66.3 | $V_H \rightarrow V_L$ | SEQ ID NO: 413 |
| R88 | Nectin-4 | 66.3 | $V_L \rightarrow V_H$ | SEQ ID NO: 414 |
| R89 | PSMA | SAM3.1 | $V_H \rightarrow V_L$ | SEQ ID NO: 415 |
| R90 | PSMA | SAM3.1 | $V_L \rightarrow V_H$ | SEQ ID NO: 416 |
| A16 | EGFR | G30Y | $V_H \rightarrow V_L$ | SEQ ID NO: 417 |
| A17 | EGFR | G30Y | $V_L \rightarrow V_H$ | SEQ ID NO: 418 |

Figure 11A:
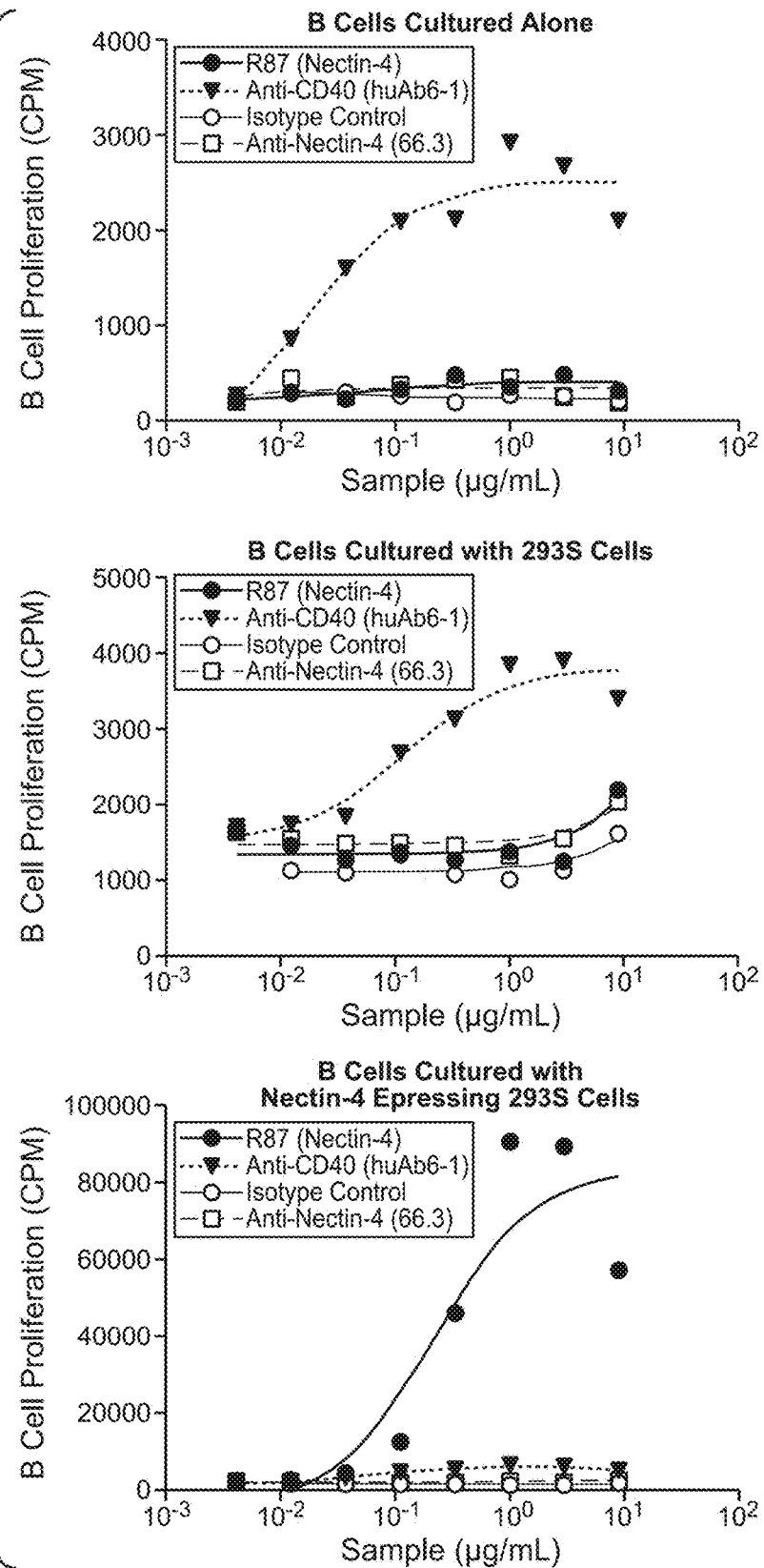
Figure 11B:
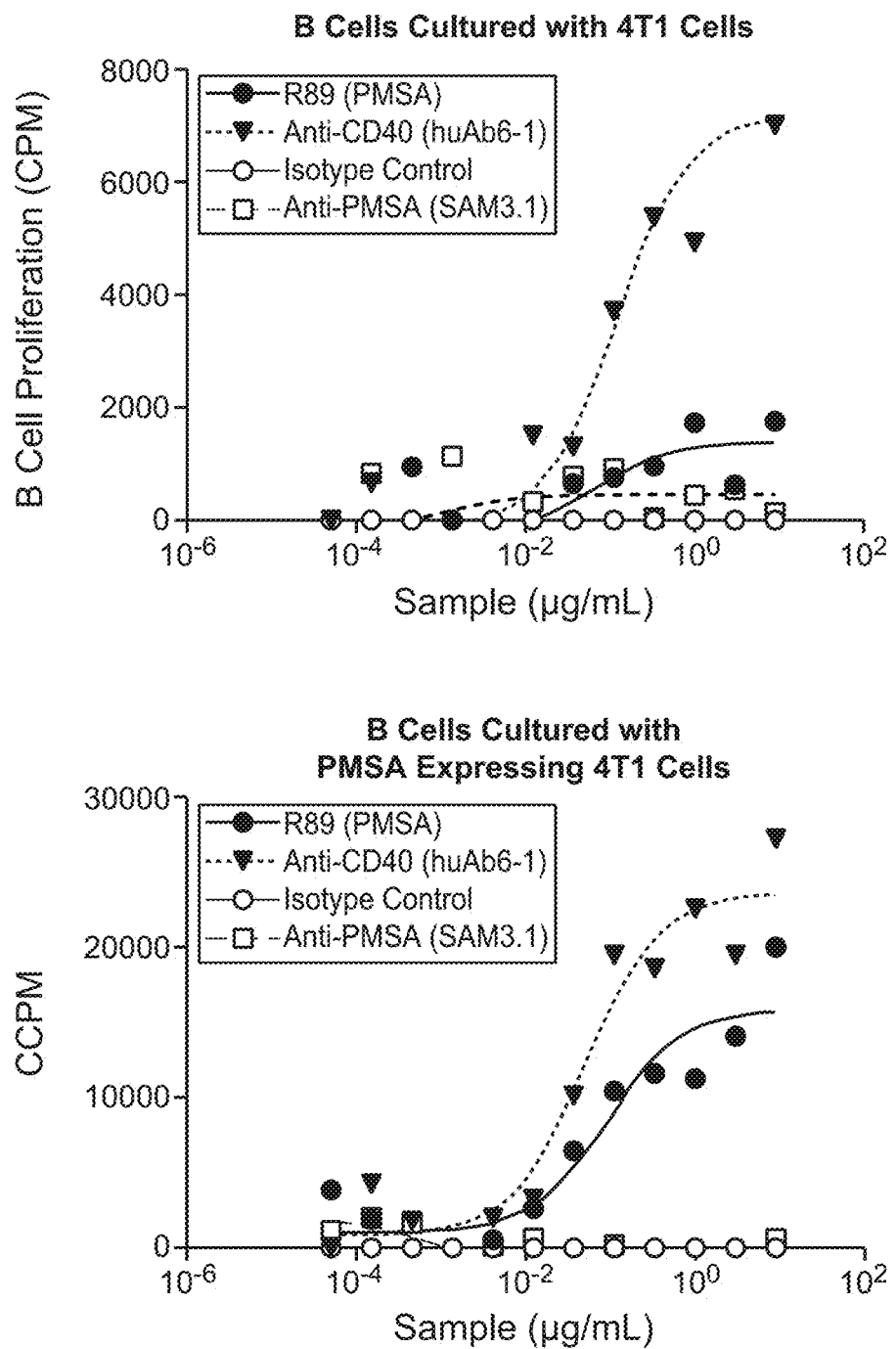

In illustrative examples of a bispecific binding protein of formula (I), the enhancement of B cell activation is observed with the exemplary binding protein R87 that binds to CD40 and nectin-4 (FIG. 11A), as well as the exemplary bispecific protein R89 that binds to CD40 and PSMA (FIG. 11B). FIG. 11A illustrates that R87 induced minimal B cell proliferation similarly to isotype matched negative control when incubated with B cells alone (upper graph), or B cells cultured with HEK293 cells (middle graph). When B cells cultured with HEK293 cells expressing nectin-4 (lower graph), R87 enhanced B cell proliferation to the level significantly higher than that stimulated by anti-CD40 antibody huAb6-1. Similarly, in FIG. 11B, R89 effects little to no B cell proliferation in the co-cultures with 4T1 cells without PSMA, but significantly enhanced B cell proliferation when B cells co-cultured with 4T1 cells expressing PSMA.

Example 7—Design and In Vitro Evaluation of Bispecific Proteins of Formula (I) Binding 4-1BB and Tumor Antigens Anti-4-1BB rat antibodies TABBY106 and TABBY107 were humanized according to methods known in the art to provide humanized antibodies having variable heavy and light chains shown in FIGS. 7D-7E. Antibody variable regions were humanized using a structure-guided method as described by Queen et al. (Proc. Natl. Acad. Sci. USA, 1989; 86:10029-10033). Human V region frameworks to be used as acceptors for rodent CDR regions were chosen based on sequence homology, and a homology model of the variable region was constructed in silico. Amino acids in the V regions predicted to have contact with the CDR regions were substituted with the corresponding residues of the rodent antibody where different.

Antibody hu106-1 has a $V_H$ of SEQ ID NO:69 and a $V_L$ of SEQ ID NO:89, while hu107-1 has a $V_H$ of SEQ ID NO:71 and a $V_L$ of SEQ ID NO:94. Both hu106-1 and hu107-1 display human IgG$_1$ constant regions with L234A and L235A variants. Humanized hu107-1 showed similar binding profiles by surface plasmon resonance (Table 7-1) compared with that of rat TABBY107 as described in Example 3.

TABLE 7-1

Humanized 4-1BB antibody binding kinetics*

| | Human 4-1BB | | | Mouse 4-1BB | | |
|---|---|---|---|---|---|---|
| Antibody | $k_a$ (1/M-s) | $k_d$ (1/s) | $K_D$ (M) | $k_a$ (1/M-s) | $k_d$ (1/s) | $K_D$ (M) |
| hu106-1 | 5.7E+05 | 7.4E-02 | 1.3E-07 | 2.2E+06 | 3.6E-02 | 1.7E-08 |
| hu107-1 | 4.1E+05 | 6.5E-05 | 1.6E-10 | 2.4E+05 | 1.3E-03 | 5.2E-09 |

*Values refer to exponential notation, e.g., 3.0E−09 = 3.0 × 10$^{-9}$.

Exemplary proteins of formula (I) binding 4-1BB and mesothelin were generated from the $V_H$ and $V_L$ of the humanized anti-4-1BB antibodies along with the amino acid sequences for anti-mesothelin antibodies discussed above. Amino acid sequences for exemplary binding proteins are shown in FIG. 8I-8M.

Exemplary binding data was determined using surface plasmon resonance for bispecific protein of formula (I) comprising humanized 4-1BB and humanized MSLN binding regions (Table 7-2). Cross-reactivity to human, cynomolgus monkey and mouse 4-1BB was retained as well as binding to human mesothelin.

TABLE 7-2

Binding of exemplary bispecific proteins to 4-1BB and mesothelin*

| | Species Receptor $K_D$ (M) | | | |
|---|---|---|---|---|
| Protein | human 4-1BB | cynomolgus 4-1BB | mouse 4-1BB | human MSLN |
| hu106MSLN-1 | 8.0E-07 | 4.2E-07 | 7.1E-08 | 4.7E-09 |
| hu106MSLN-2 | 6.7E-07 | 6.6E-07 | 7.4E-08 | 4.5E-09 |
| hu106MSLN-3 | 2.3E-06 | 4.1E-06 | 1.1E-07 | 1.4E-09 |
| hu106MSLN-4 | 1.4E-06 | 9.4E-07 | 1.4E-07 | 1.4E-09 |
| hu107MSLN-1 | 1.4E-09 | 5.5E-10 | 2.9E-08 | 3.6E-09 |
| hu107MSLN-2 | 3.6E-09 | 1.4E-09 | 4.4E-08 | 3.1E-09 |
| hu107MSLN-3 | 7.1E-09 | 4.5E-09 | 4.9E-08 | 1.5E-09 |
| hu107MSLN-4 | 6.1E-09 | 3.3E-09 | 5.2E-08 | 1.4E-09 |

*Values refer to exponential notation, e.g., 3.0E-09 = 3.0 × 10$^{-9}$.

Figure 12A:
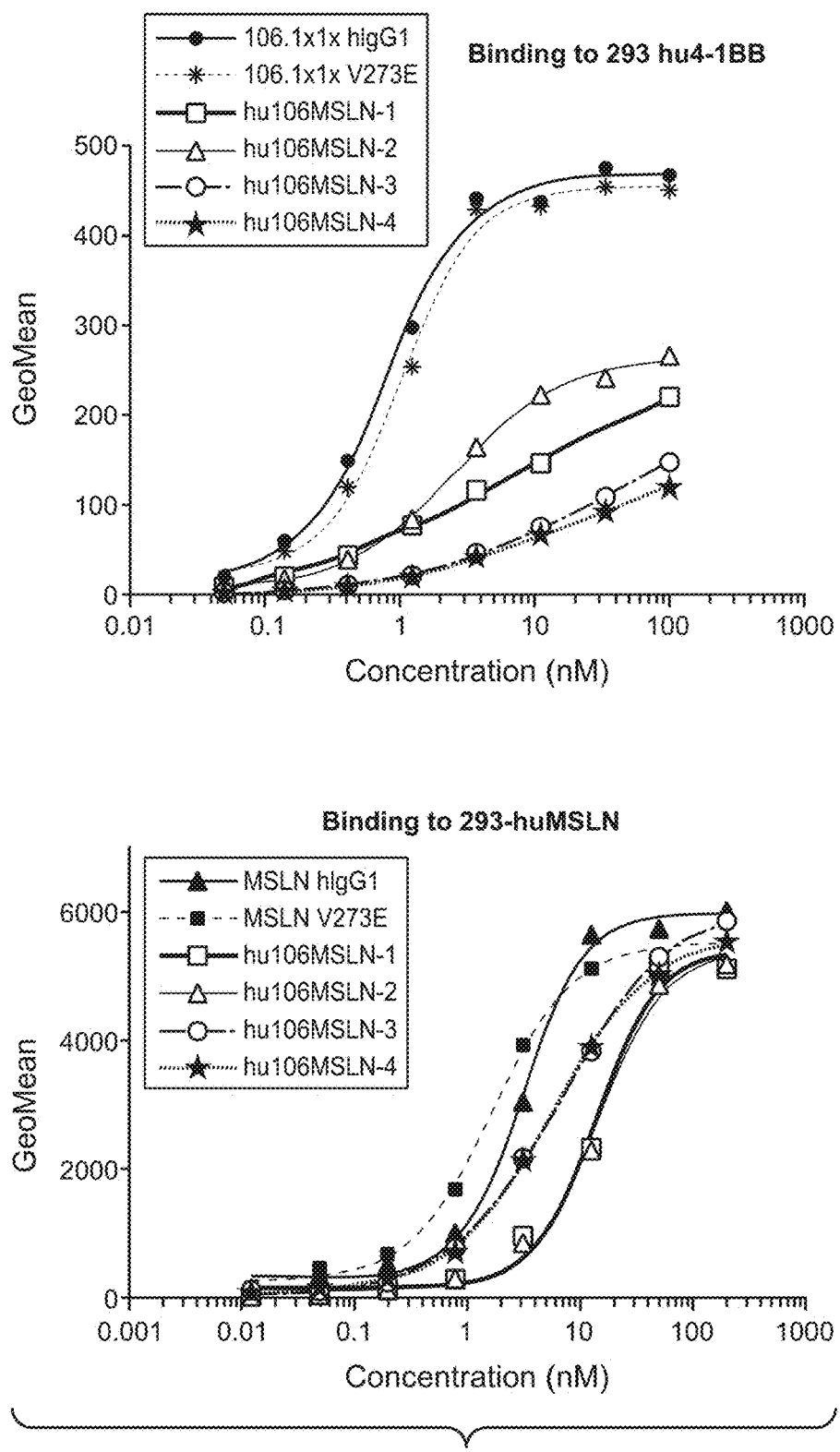
Figure 12B:
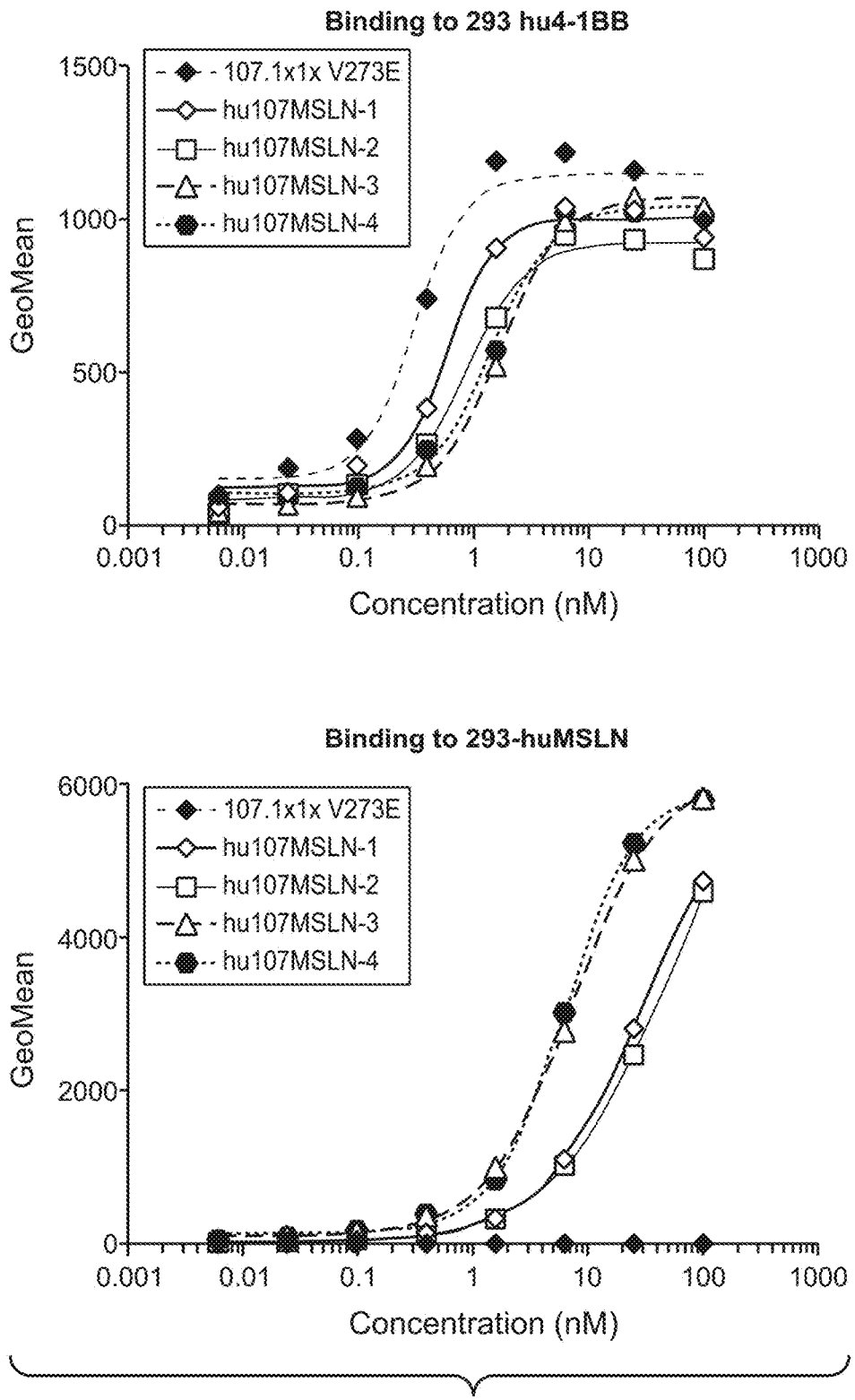

The binding activity of exemplary binding proteins to endogenous human 4-1BB and mesothelin, as well as their respective $EC_{50}$s, were demonstrated with FACS binding to HEK293 cells transfected with human 4-1BB or mesothelin using test binding protein concentrations of 0.05 nM, 0.14 nM, 0.4 nM, 1.2 nM, 3.7 nM, 11 nM, 33 nM, and 100 nM. HEK293 cells expressing human 4-1BB (upper graph) or mesothelin (lower graph) were used (FIGS. 12A-12B). Anti-4-1BB antibodies hu106 IgG$_1$ or hu106 V273E, sharing the $V_H$ and $V_L$ of hu106-1 with different huIgG1 constant regions ("106.1×1×," upper left, either with human IgG$_1$ or huIgG1 V273E variant, respectively), or hu107 V273E, sharing the $V_H$ and $V_L$ of hu107-1 with a different huIgG1 constant region ("107.1×1×," lower graphs, with huIgG$_1$ V273E), or mesothelin antibody HuAM15 (upper right) were used as controls. With both 4-1BB and mesothelin, the exemplary binding proteins of the disclosure demonstrate binding to the desired targets.

Figure 13:
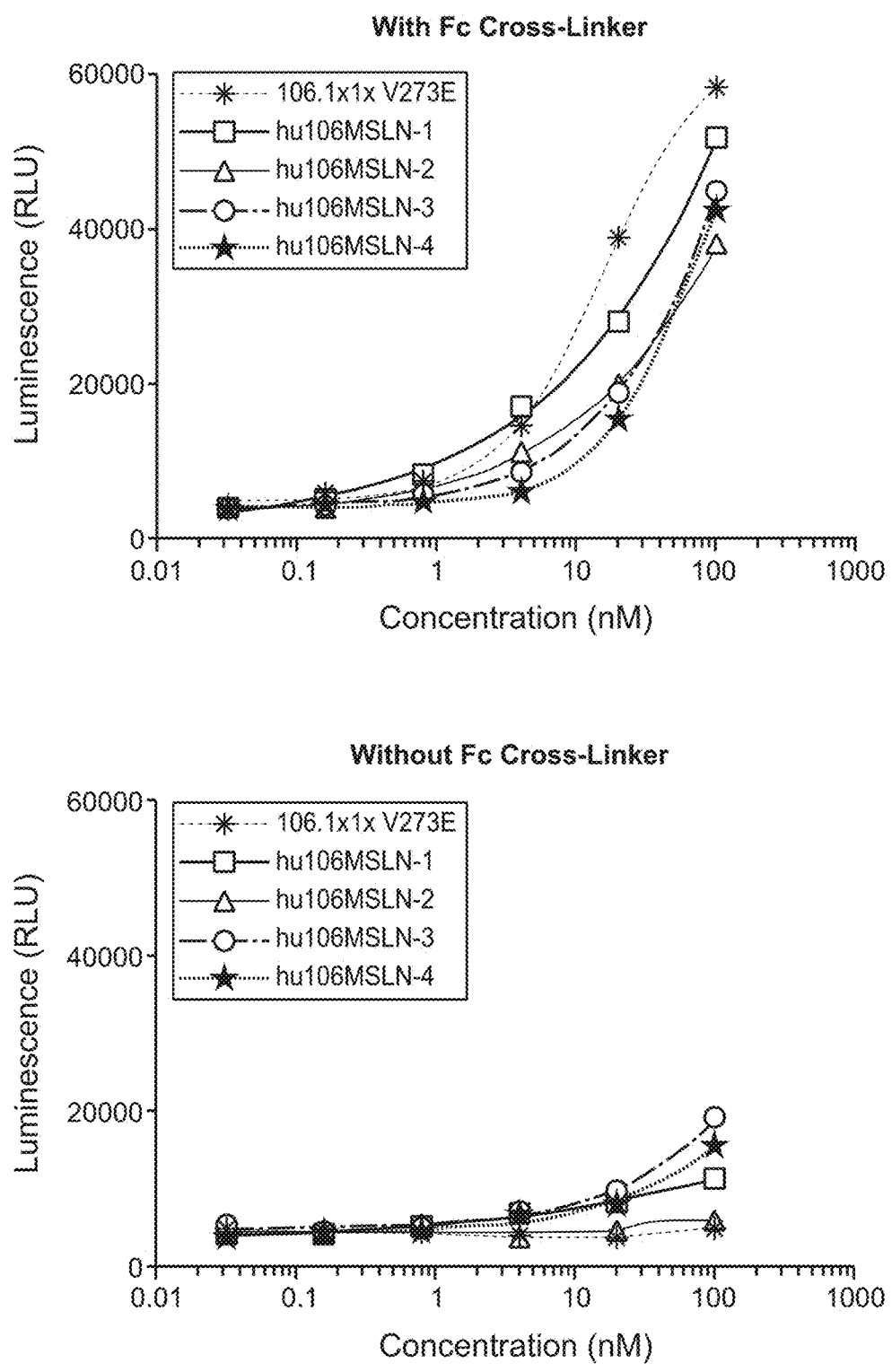

In HEK293 cells transfected with human 4-1BB and luciferase reporter gene driven by NF-κB, exemplary bispecific binding proteins of formula (I) binding to 4-1BB and mesothelin showed 4-1BB agonist activity only in the presence of an Fc cross-linker to help clustering of the 4-1BB receptor (upper graph) and did not show activity in the absence of an Fc cross-linker, Goat anti-human Fcγ antibody (lower graph) (FIG. 13). The NF-κB HEK293 cell assay was performed according to the 4-1BB NF-κB reporter assay described in Example 3.

Figure 14A:
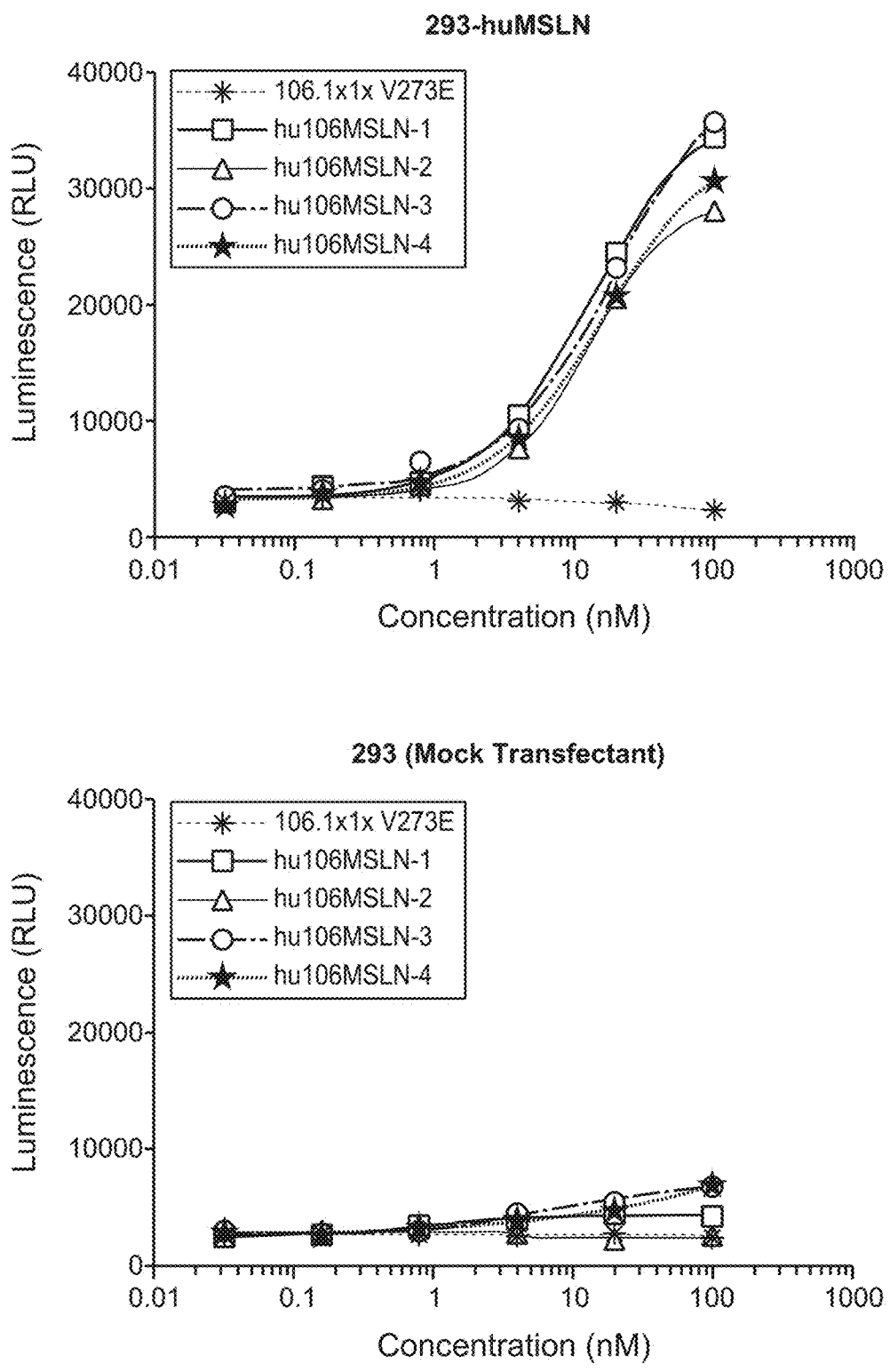
Figure 14B:
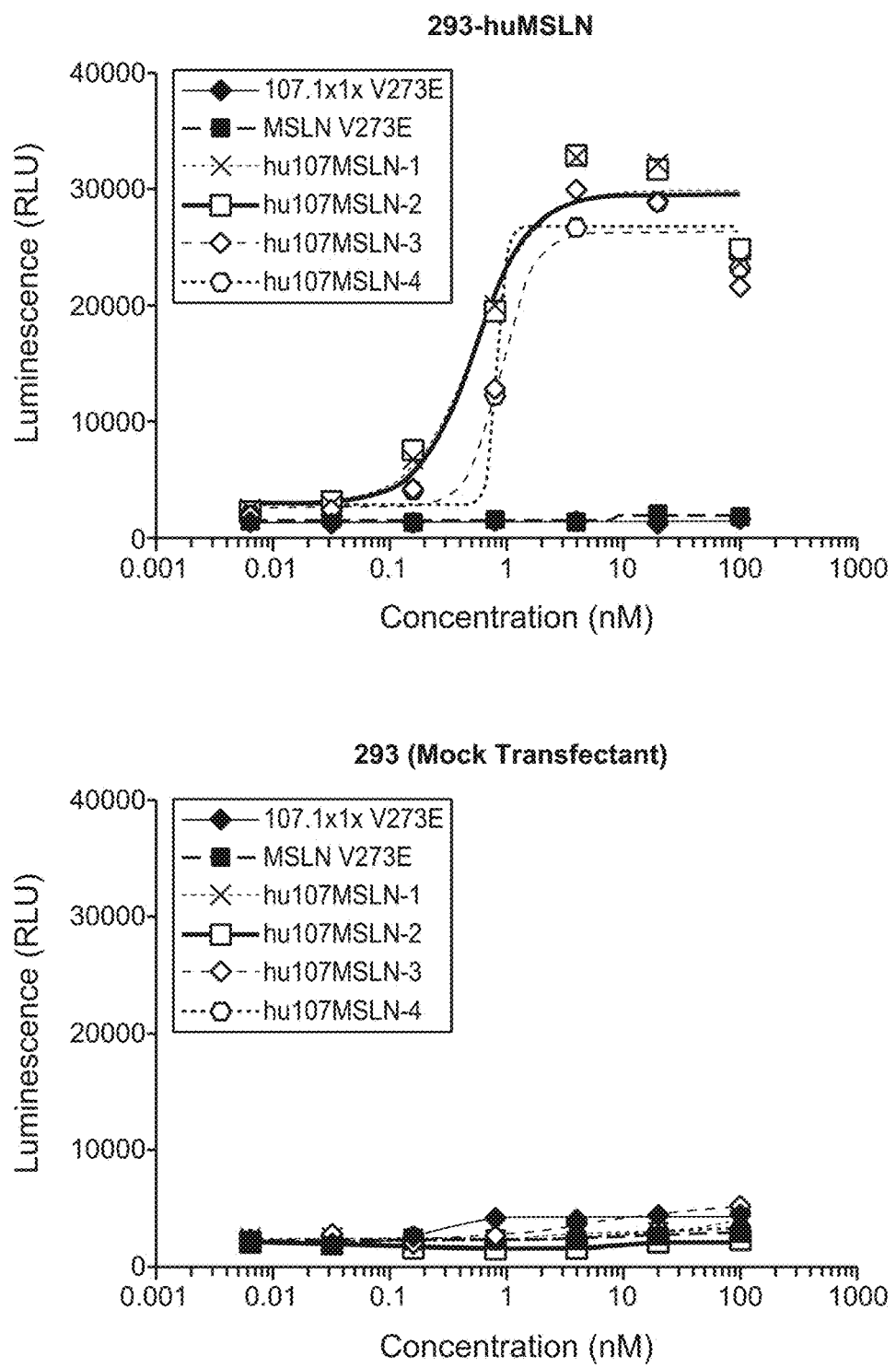

The exemplary bispecific binding proteins of formula (I) that bind to 4-1BB and mesothelin demonstrate cell-surface human mesothelin-dependent activation of NF-κB. As shown in FIGS. 14A-14B, the bispecific binding proteins exhibited activation of NF-κB in HEK293 cells expressing cell-surface mesothelin (upper graphs), while little to no activation was observed in dosing the bispecific binding proteins in HEK293 cells treated with mock transfectant (lower graphs).

Figure 15A:
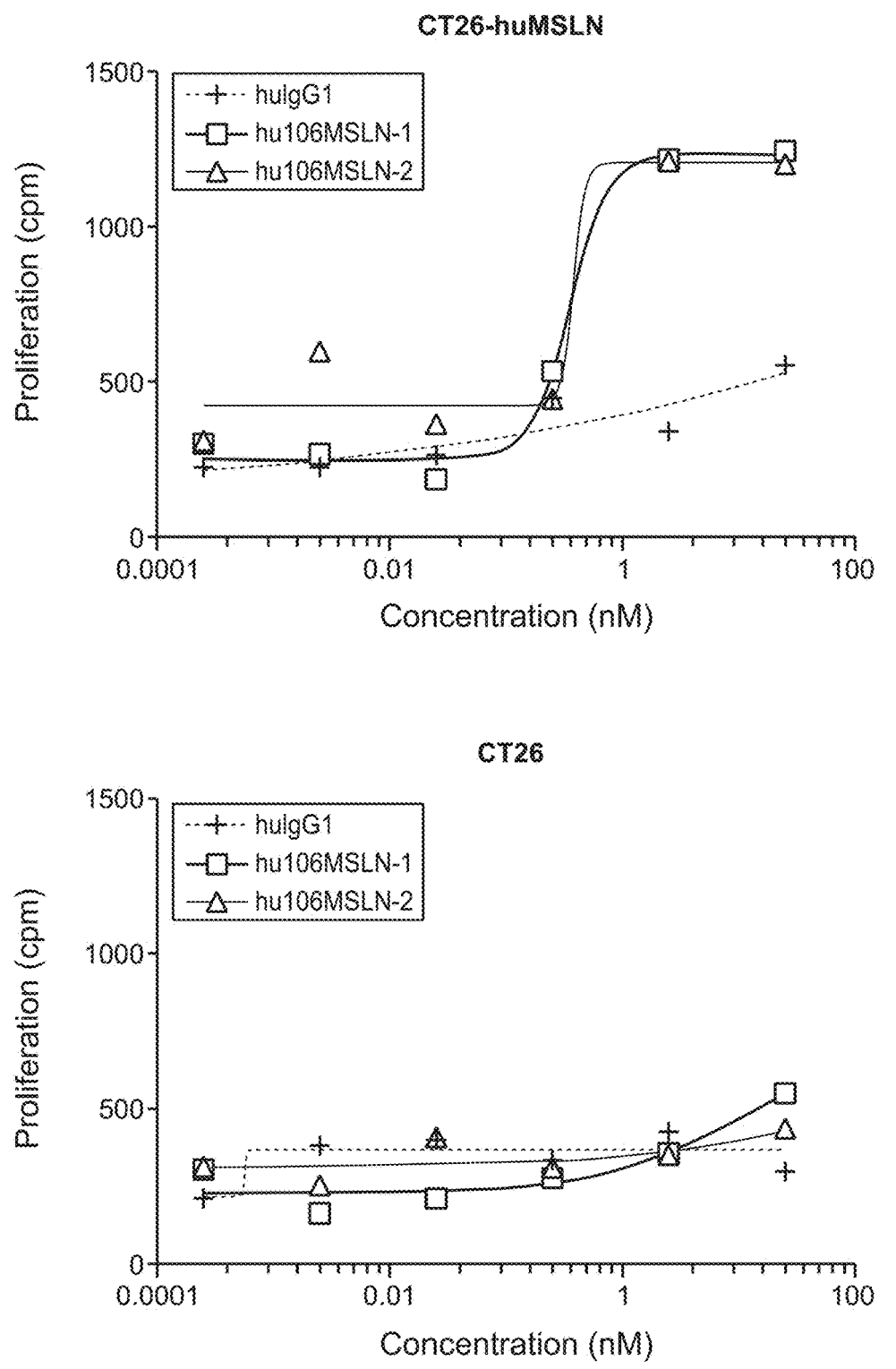
Figure 15B:
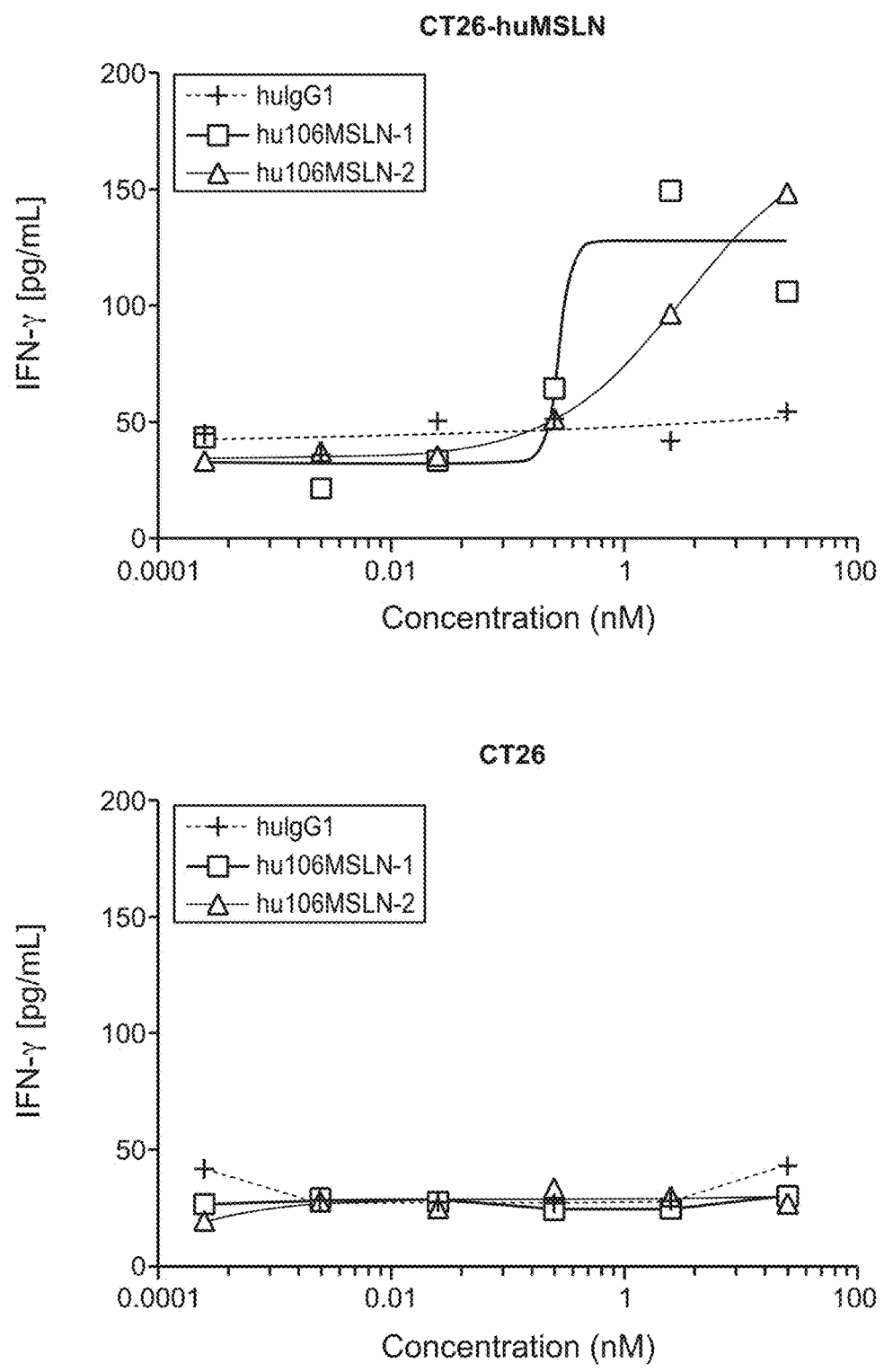
Figure 15C:
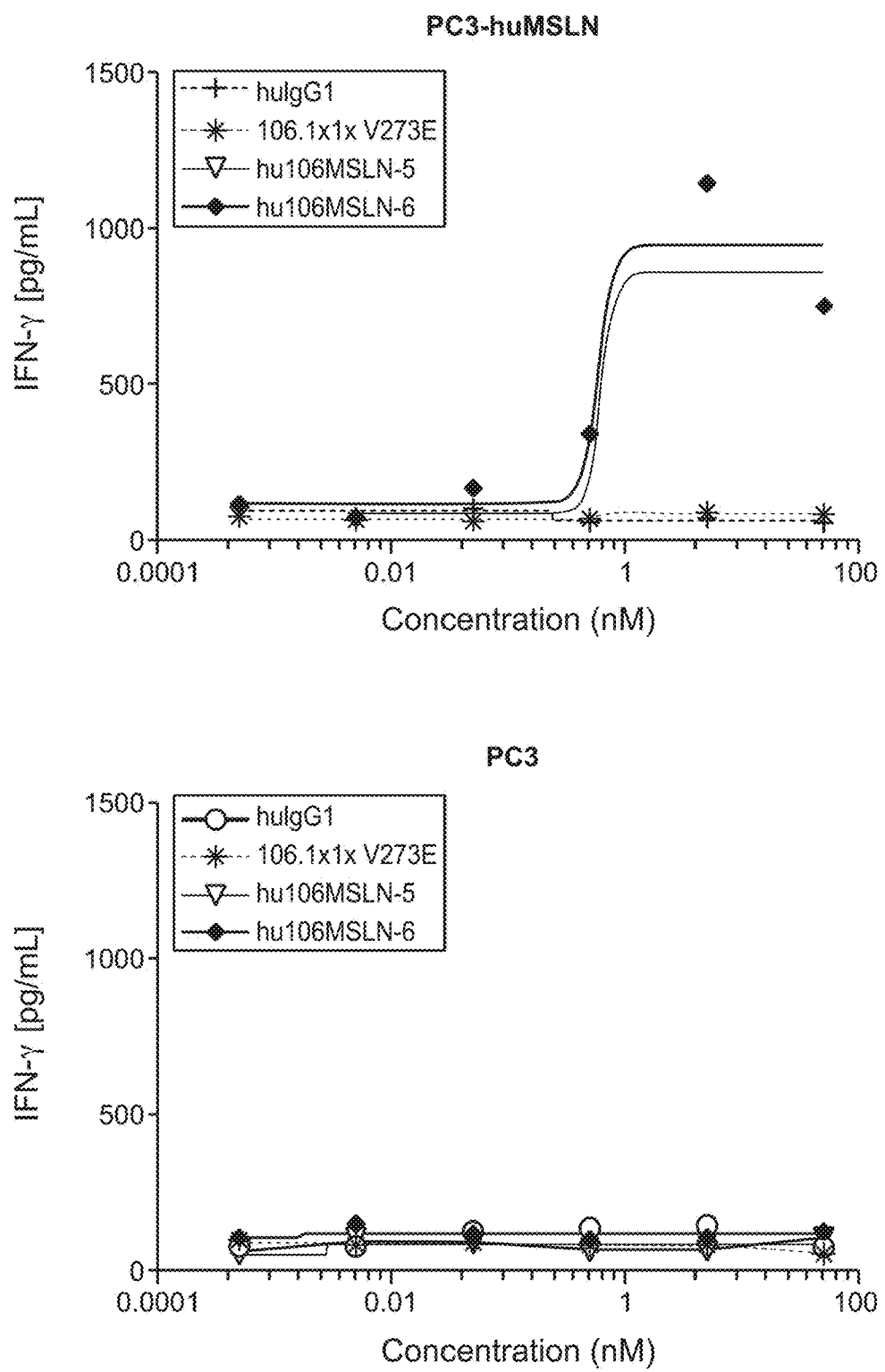

Additionally, exemplary bispecific binding proteins of formula (I) binding to both 4-1BB and mesothelin can also induce 4-1BB-mediated specific activation of CD8+ T cells. As shown in FIGS. 15A-15B, activation of CD8+ T cells was measured by T-cell proliferation (FIG. 15A) or interferon-gamma production (FIG. 15B) according to the assays described in Example 3 demonstrates conditional activation of CD8+ T cells in the presence of CT26 cells expressing mesothelin but not in co-cultures containing CT26 cells that do not express mesothelin. In a similar manner, CD8+ T cells were stimulated by bispecific proteins binding 4-1BB and mesothelin in the presence of PC3 cells expressing mesothelin (upper graph) but not in PC3 cells alone (lower graph) (FIG. 15C).

Exemplary bispecific binding proteins of formula (I) binding 4-1BB and PSMA were generated from the $V_H$ and $V_L$ of the humanized anti-4-1BB antibodies along with the amino acid sequences for anti-mouse PSMA antibodies Amino acid sequences for anti-PSMA antibodies are shown in FIGS. 10A, 10J, and 10K, and for exemplary binding proteins in FIG. 10L.

Figure 15D:
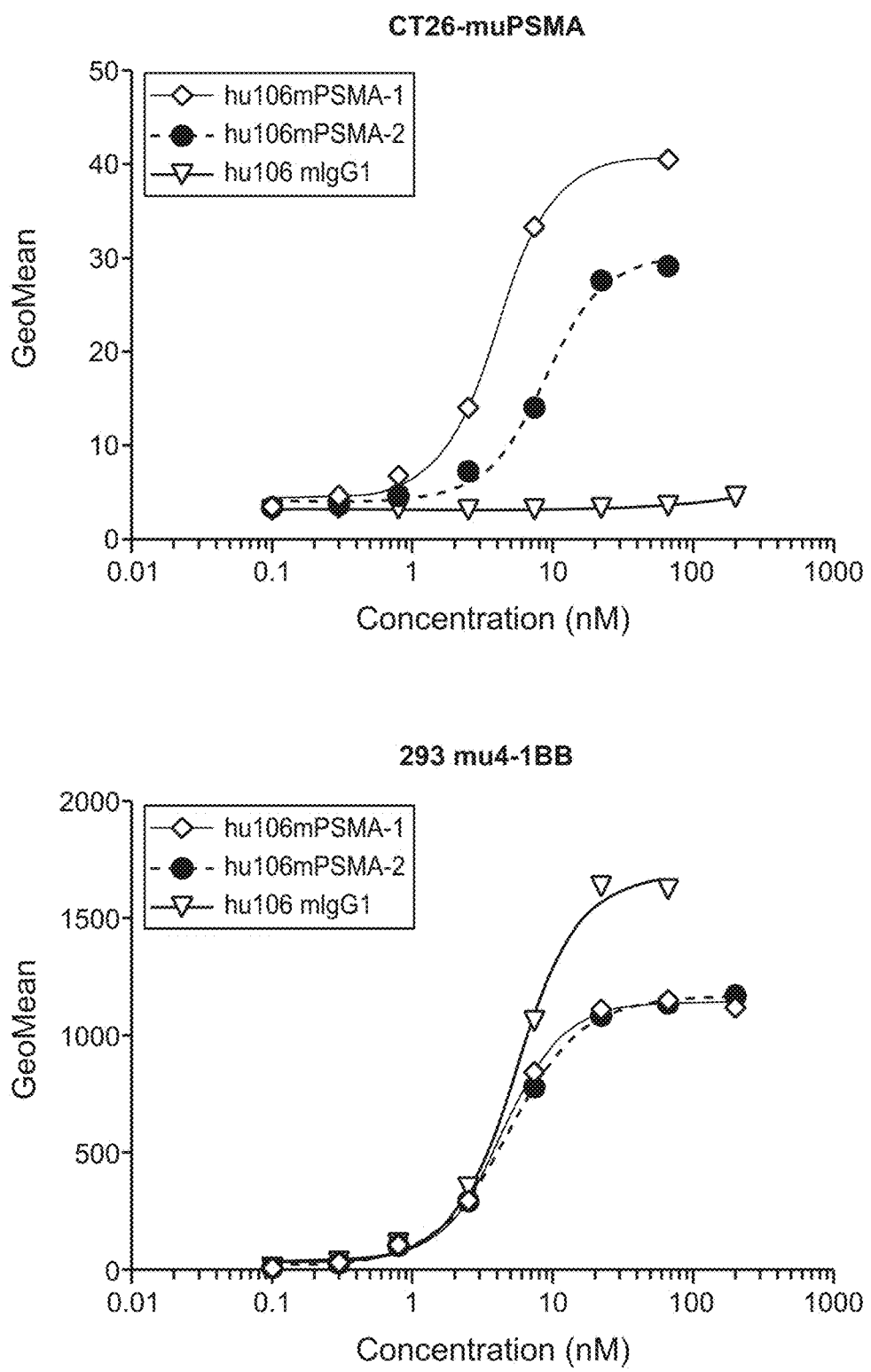
Figure 15E:
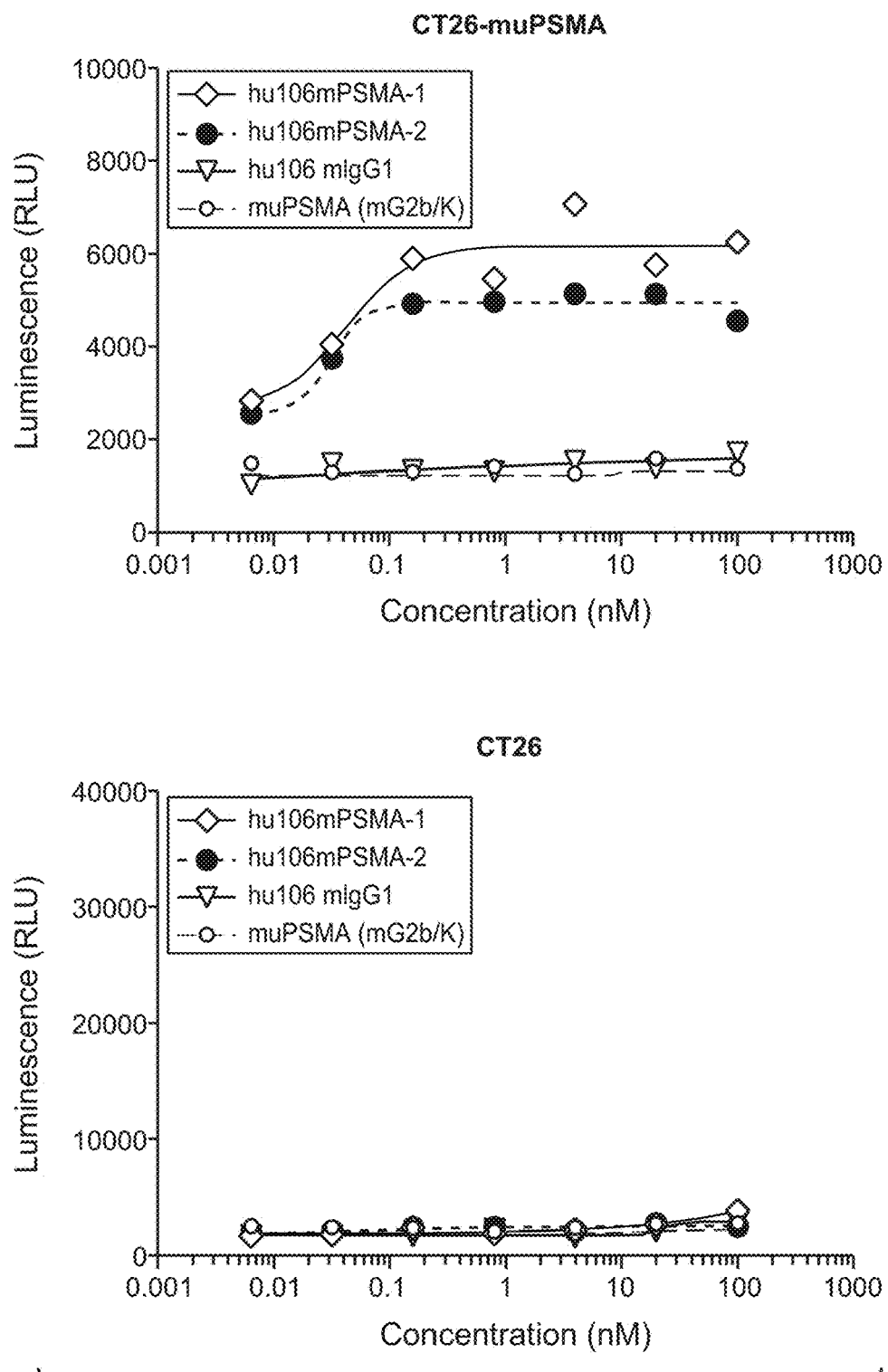

The bispecific binding proteins of formula (I) bind to both 4-1BB and PSMA and demonstrated cell-surface mouse PSMA-dependent activation of NF-κB. As shown in FIGS. 15D-15E, the bispecific binding proteins exhibited activation of NF-κB in HEK293 cells expressing cell-surface PSMA (FIG. 15D). Additionally, hu106mPSMA-1 and hu106mPSMA-2 showed activation in CD8+ T cells in the presence of CT26 cells expressing PSMA but not in co-cultures containing CT26 cells that do not express PSMA (FIG. 15E).

Exemplary bispecific binding proteins of formula (I) binding 4-1BB and B7-H4 were generated from the $V_H$ and $V_L$ of the humanized anti-4-1BB antibodies along with the amino acid sequences for anti-B7-H4 antibodies. Amino acid sequences for anti-B7-H4 antibodies are shown in FIGS. 10E-10G, and for exemplary binding proteins in FIG. 10H-10I.

A bispecific binding protein of the DVD-Ig format according to FIG. 2A was generated with the 4-1BB variable domains of hu106-1 and the mesothelin domains of HuAM15. However, the 4-1BB DVD-Ig bispecific protein did not show conditional activation of CD8+ T cells in CT26 expressing mesothelin co-cultured with CD8+ T cells, in contrast to the bispecific binding proteins of formula (I) described above.

Figure 16:
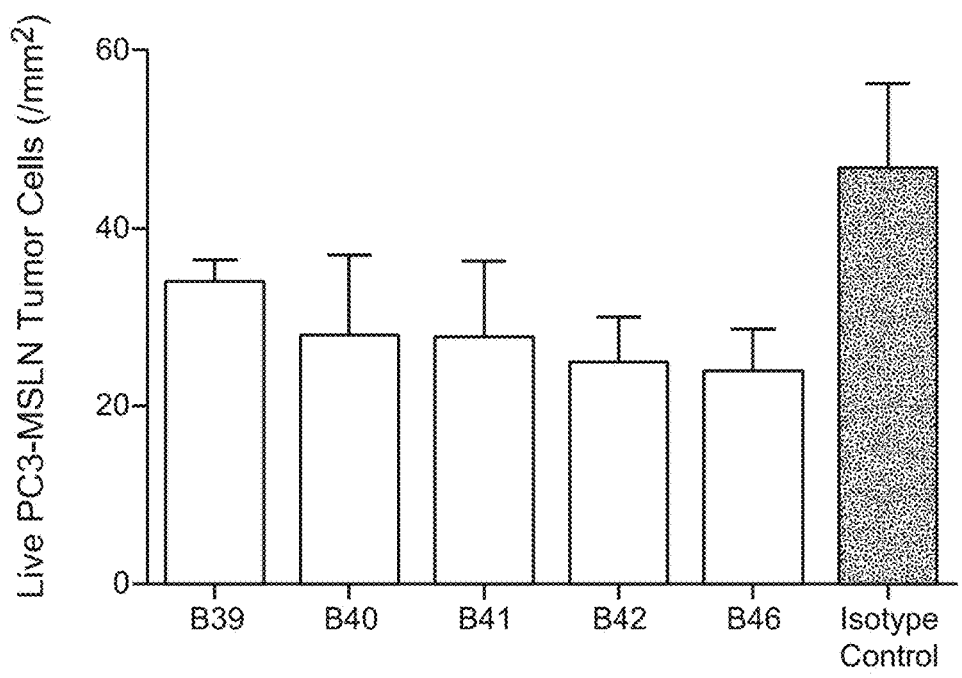

Example 8—CD40/Tumor Antigen Bispecific Proteins Show In Vitro Antitumor Activity in Cancer Cell Culture Exemplary bispecific binding proteins of formula (I) demonstrated a conditional immune activation that mediated killing of tumor cells in culture. An assay was performed which tested the ability of exemplary CD40/MSLN bispecific binding proteins in stimulating human autologous moDCs to drive T cells to kill a tumor cell line expressing MSLN. In this assay, PC3 tumor cells stably expressing MSLN and green fluorescent protein (GFP) were cultured with autologous DC and T cells, and treated with control or bispecific molecules. After being treated for 4 days, the live cells were quantified based on the green fluorescence. As shown in FIG. 16, the viable cell number was lower in the culture treated with exemplary bispecific binding proteins that bind both CD40 and mesothelin as compared to isotype matched negative control antibody, suggesting CD40/MSLN bispecific binding proteins of formula (I) exhibited in vitro antitumor activity.

Example 9—CD40/Tumor Antigen Bispecific Proteins Show In Vivo Antitumor Activity in Prophylactic Cancer Models Bispecific proteins of formula (I) binding to CD40 and a tumor antigen have shown to prevent the growth of tumor cells expressing a cell-surface tumor antigen in prophylactic cancer animal models. Exemplary bispecific binding proteins were evaluated for their ability to inhibit the growth of PC3 xenograft tumors expressing the cognate tumor antigen. NSG mice were inoculated subcutaneously with a mixture of purified T cells ($5 \times 10^5$), autologous DCs ($1 \times 10^5$), and PC3-MSLN, PC3-Nectin-4, or PC3-PSMA cells ($1 \times 10^6$). A single dose of the anti-CD40 antibodies or control antibodies at 1 mg/kg, or a bispecific protein of formula (I) at 1 mg/kg, was injected intraperitoneally immediately after inoculation. Tumor volumes were measured every other day with calipers. Each data point represents the mean tumor volume of a group of eight animals.

Figure 17A:
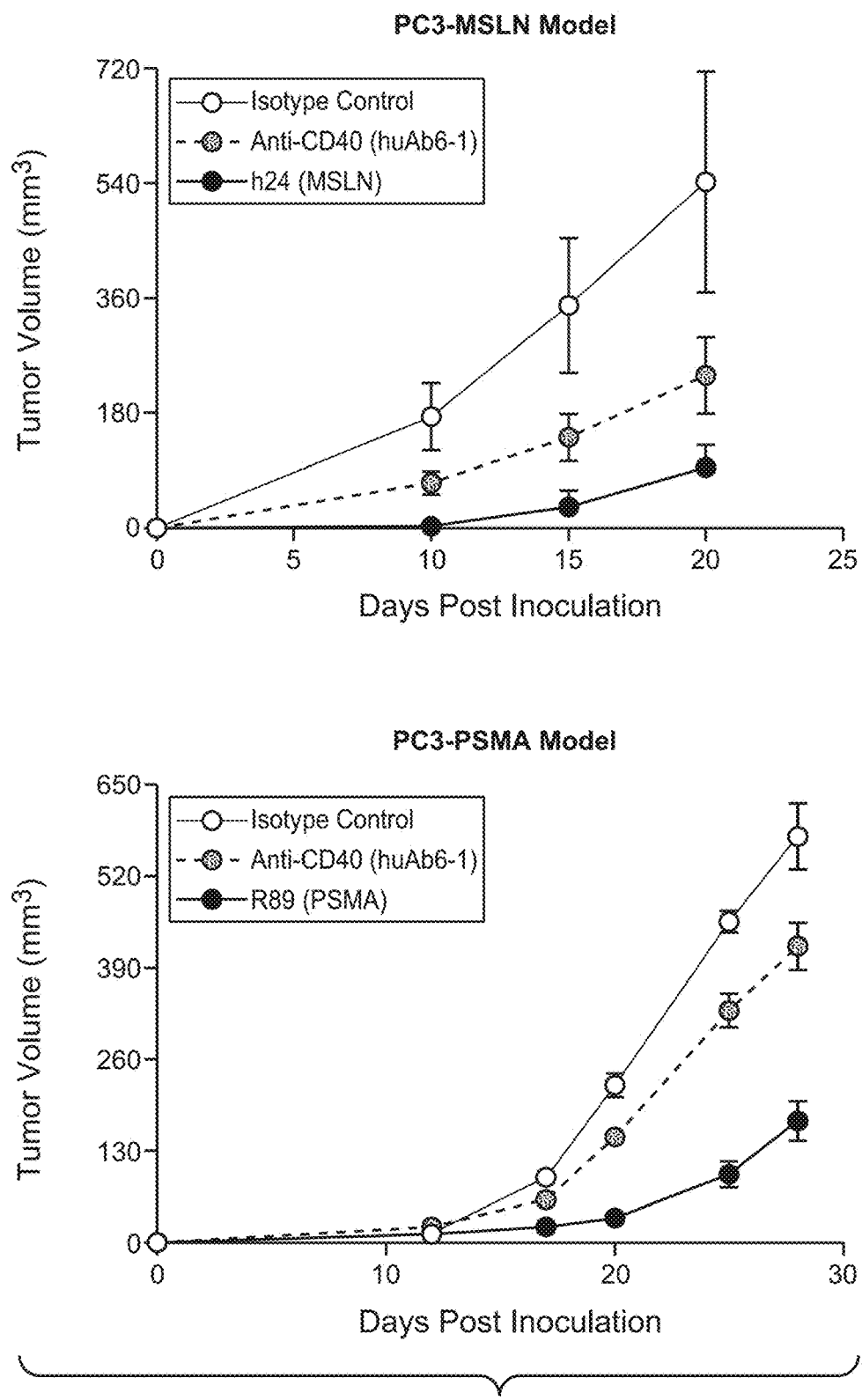
Figure 17B:
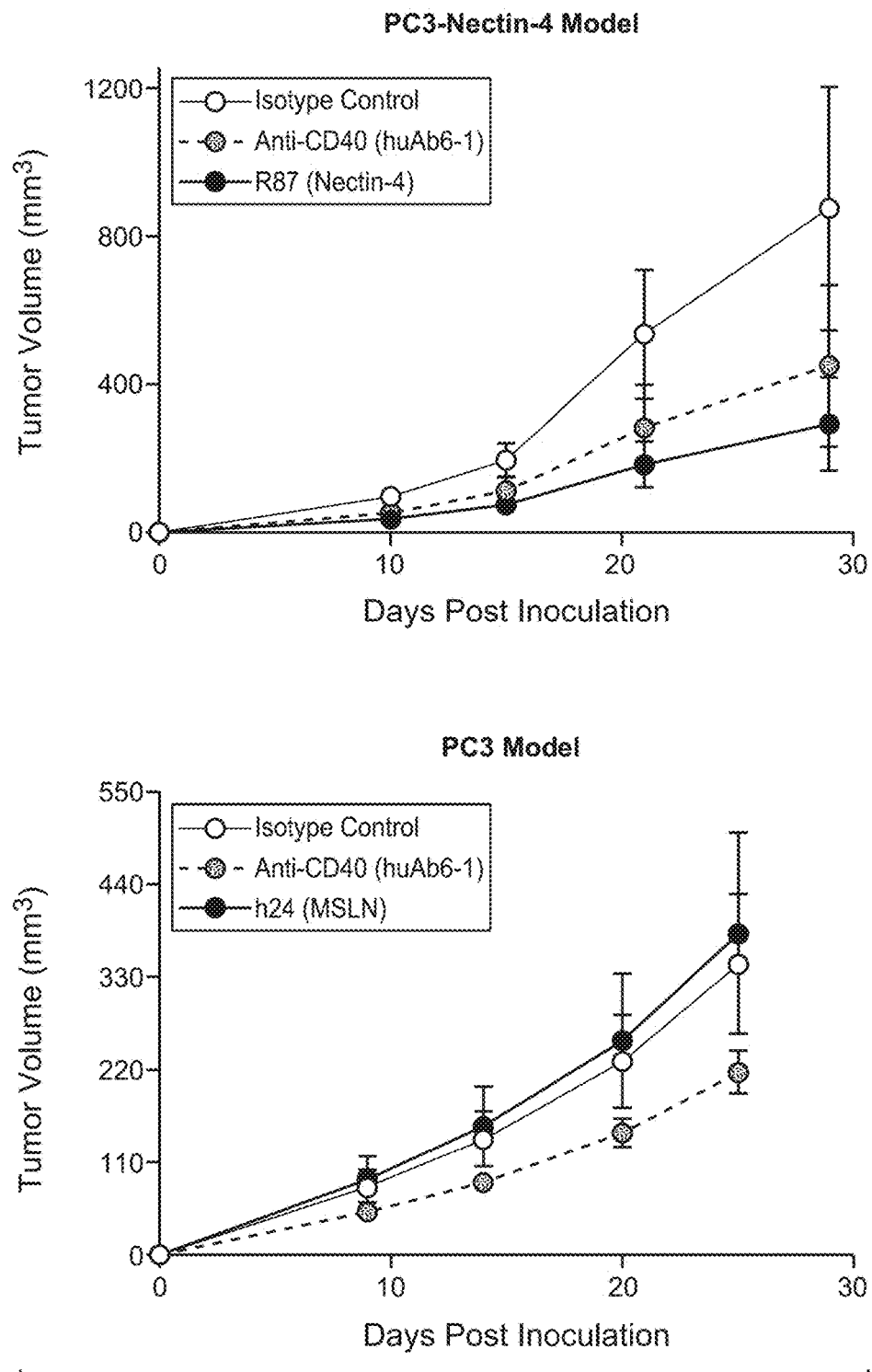

As shown in FIGS. 17A-17B, exemplary binding proteins binding to CD40 and either mesothelin (MSLN), PSMA or nectin-4 exhibited a more potent effect on preventing the growth of PC3 human prostate cancer tumors expressing the respective cell-surface antigens, as compared to an isotype control. In both the model with PC3 cells expressing MSLN (FIG. 17A, upper graph) and with PC3 cells expressing nectin-4 (FIG. 17B, upper graph), the bispecific proteins h24 and R87, respectively, showed better or similar antitumor activity as compared with anti-CD40 antibody huAb6-1. Bispecific protein B89 binding CD40 and PSMA afforded an antitumor activity better than that observed with its corresponding anti-CD40 antibody huAb6-1 (FIG. 17A, lower graph). By contrast, in PC3 cells that do not express mesothelin (FIG. 17B, lower graph), the bispecific binding protein h24 demonstrated effects that are not statistically different than an isotype control antibody.

Example 10—Evaluation of Exemplary CD40/Mesothelin Bispecific Proteins in Mouse Syngeneic Tumor Model To test whether CD40/MSLN bispecific proteins could enhance the therapeutic window, a proof-of-concept formula (I) molecule LB-1 was generated targeting murine CD40 and MSLN. LB-1 contains N-terminal scFv ($V_H \rightarrow V_L$) derived from 1C10 (an agonist anti-CD40 monoclonal antibody that binds to mouse CD40), followed by a murine IgG$_1$ hinge, heavy chain CH2/CH3, and the C-terminal scFv domain ($V_H \rightarrow V_L$) derived from anti-MSLN monoclonal antibody clone MOR06626 (see, US Patent Appl. No. 2011/0027268) with cross-reactivity to both human and murine MSLN. The amino acid sequence of LB-1 (SEQ ID NO:400) is shown in FIG. 8A.

The binding data of mouse bispecific formula (I) protein LB-1 are summarized in Table 10-1. While LB-1 shows some attenuation of $EC_{50}$ binding to CD40 and mesothelin as compared to antibodies 1C10 and MOR06626 with murine IgG1(mIgG1), respectively, maximum binding was preserved for each target.

TABLE 10-1

Antigen binding of mouse bispecific binding protein LB-1

| Protein | MSLN binding | | CD40 binding | |
|---|---|---|---|---|
| | $EC_{50}$ (µg/mL) | Maximum Binding (% MOR06626 binding) | $EC_{50}$ (µg/mL) | Maximum Binding (% 1C10 binding) |
| LB-1 | 1.39 | 100 | 2.75 | 100 |
| anti-MSLN antibody (MOR06626 mIgG1) | 0.06 | 100 | — | — |
| anti-CD40 antibody (1C10 mIgG1) | — | — | 0.21 | 100 |

8.10.1. CD40/Mesothelin Bispecific Protein LB-1 Shows In Vivo Antitumor Activity in Mouse Syngeneic Tumor Model A murine tumor cell line 4T1 stably expressing MSLN (4T1-MSLN) was used to establish tumors in syngeneic immunocompetent Balb/c mice. The efficacy and toxicity of exemplary bispecific binding protein of formula (I) LB-1 was compared with anti-CD40 1C10 mIgG1 in the 4T1-MSLN syngeneic mouse model. Mice bearing 4T1-MSLN tumors (50 mm$^3$) were randomized into the following eight groups: a murine isotype control group at 5 mg/kg, an anti-MSLN antibody MOR06626 mIgG1 at 5 mg/kg, and groups for anti-CD40 antibody 1C10 mIgG1 and for bispecific protein LB-1, each with three dosing groups at 1.25, 2.5 and 5 mg/kg. Dosing started at randomization with lqw (i.e., once weekly dosing) for 3 weeks. Blood samples were taken at 24 hours after the 2nd dose, and were subject to VetScan analysis for ALT level. Serum cytokines were measured by LUMINEX® cytokine multiplex assay (Millipore).

Figure 18:
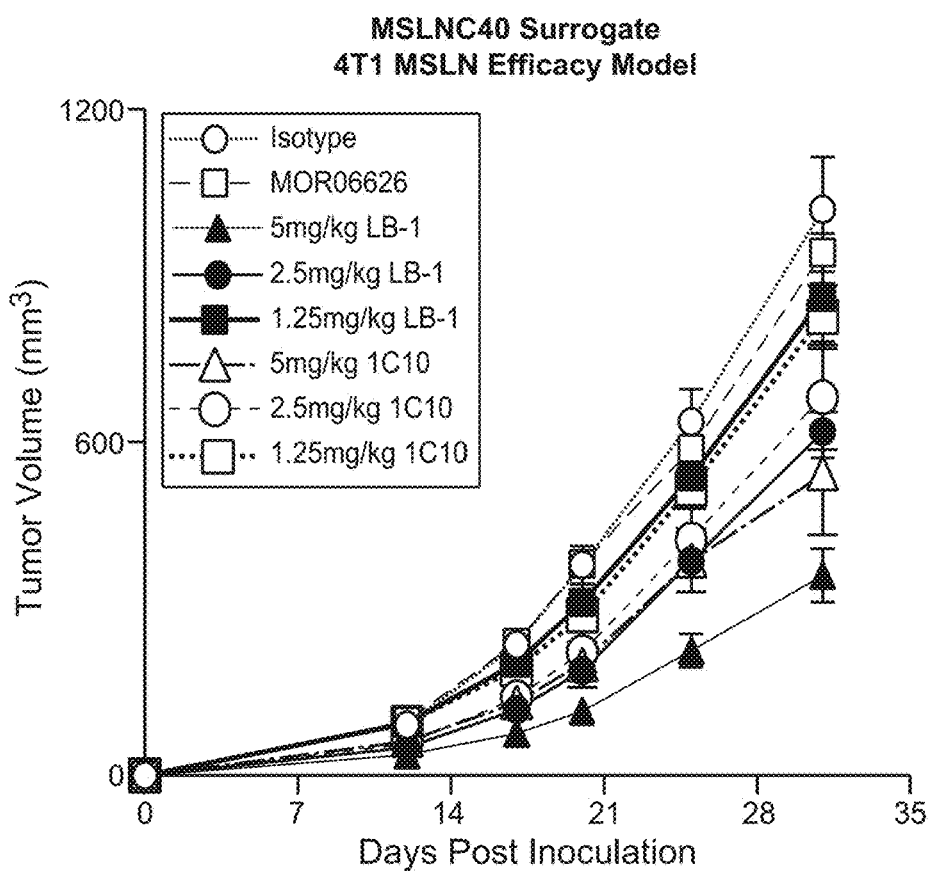
FIG. 18 shows effects of anti-CD40 antibody 1C10 and bispecific binding protein LB-1 on tumor volume in mice carrying 4T1 syngeneic tumors expressing mesothelin ("4T1 MSLN").

Both anti-CD40 antibody 1C10 mIgG1 and bispecific binding protein LB-1 inhibited 4T1-MSLN tumor growth in a dose-dependent manner, while the anti-MSLN antibody MOR06626 mIgG1 had comparable antitumor activity to antibody isotype (FIG. 18). At the 5 mg/kg doses, both bispecific binding protein LB-1 and anti-CD40 antibody 1C10 mIgG1 showed significantly higher inhibition of tumor growth compared with isotype control.

8.10.2. CD40/Mesothelin Bispecific Protein LB-1 Shows Reduced Toxicity In Vivo Compared with Literature Anti-CD40 Antibody 1C10

In the experiment described above, the exemplary bispecific protein LB-1 that activated CD40 in the presence of cell-surface mesothelin showed an improved liver toxicity as compared with the anti-CD40 antibody 1C10 at the same dose. At the efficacious dose level of 5 mg/kg, anti-CD40 antibody 1C10 induced liver toxicity, as indicated by the elevated levels of the liver enzyme alanine aminotransferase (ALT) in circulation. At the same dose level, the bispecific formula (I) molecule LB-1 achieved anti-tumor efficacy without causing elevation of ALT in circulation. As shown in FIG. 19, the liver toxicity of bispecific protein LB-1 is lower than that of antibody 1C10 at 5 mg/kg, as measured by elevated ALT levels in mouse liver.

Additionally, at 5 mg/kg of each, the bispecific binding protein LB-1 did not exhibit the elevated serum cytokine levels demonstrated upon administration of anti-CD40 antibody 1C10 at the same dose. As shown in FIG. 20, elevated cytokine levels of interleukin-6 (IL-6) and TNF-alpha ("TNFa") (left), as well as keratinocyte chemoattractant (KC), interferon gamma-induced protein 10 (IP-10) and monokine induced by interferon-gamma (MIG) (right), were observed with 1C10 as compared with dosing of LB-1 or control mouse IgG1.

Further pharmacodynamic analysis indicated that while both anti-CD40 antibody 1C10 and bispecific protein LB-1 activated circulating B cells, LB-1 was less potent in circulation and its activity appeared to be more localized to the tumor draining lymph node. Furthermore, bispecific protein LB-1 enhanced tumor specific T-cell responses (data not shown), likely due to the tumor-localized activation of antigen presenting cells.

Example 11—Evaluation of Exemplary 4-1BB/PSMA Bispecific Proteins in Balb/c Mouse Tumor Model Exemplary bispecific proteins of formula (I) Hu106mPSMA-3 (SEQ ID NO:447) and Hu106mPSMA-4 (SEQ ID NO:448) each exhibited binding to both mouse 4-1BB and PSMA. As a result, they were selected for further evaluation in an in vivo experiment to demonstrate target engagement. The 4-1BB FACS binding data obtained according to the assay described in Section 8.3.3.2 is summarized in Table 11-1 below. Anti-4-1BB antibodies hu106-1 with the muIgG1 constant region ("hu106-1 mIgG1") and hu106-1 mIgG1 bearing T252M in the constant region ("hu106-1 T252M mIgG1"), as well as anti-4-1BB binding proteins Hu106mPSMA-3 and Hu106mPSMA-4, all exhibited in vitro binding of about 1 nM.

TABLE 11-1

Binding of Antibody or Bispecific Binding Protein to Mouse 4-1BB by FACS

| Sample | hu106-1 mIgG1 | hu106-1 T252M mIgG1 | Hu106mPSMA-3 | Hu106mPSMA-4 |
|---|---|---|---|---|
| $EC_{50}$ (nM) | 0.69 | 0.95 | 1.1 | 1.0 |

For the purpose of simplifying protein purification only, hu106-1 mIgG1 T252M, Hu106mPSMA-3, and Hu106mPSMA-4 all contained the T252M amino acid substitution in the CH2 domain to enhance affinity to protein A. See Nagaoka, M. et al. Protein Eng., vol. 16(4), pages 243-245 (2003). Hu106mPSMA-4 differed from Hu106mPSMA-3 in that the former binding protein possessed the additional amino acid substitution N297A. This mutation has previously been shown to decrease binding of anti-CD3 antibodies to mouse FcγR. See Chao, et al Immunological Investigations, vol. 38, pages 76-92 (2009). As exemplified by the comparison of hu106-1 mIgG1 and hu106-1 T252M mIgG1 in Table 11-1 above, the mutation had a minimal effect on 4-1BB binding by FACS.

The prototype bispecific proteins binding 4-1BB and PSMA also demonstrated anti-PSMA properties as measured by FACS and summarized in Table 11-2 below. The PSMA binding activity of the bispecific proteins Hu106mPSMA-3 and Hu106mPSMA-4 were comparable to that for PSMA antibody SAM103 having murine IgG2a isotype with the L234A/L235A double mutation ("mIgG2a AA").

TABLE 11-2

Binding of Antibody or Bispecific Binding Protein to Mouse PSMA by FACS

| Sample | SAM103 mIgG2a AA | Hu106mPSMA-3 | Hu106mPSMA-4 |
|---|---|---|---|
| $EC_{50}$ (nM) | 0.62 | 1.4 | 1.3 |

A murine tumor cell line CT26 stably expressing PSMA (CT26-PSMA) was used to establish tumors in syngeneic immunocompetent Balb/c mice. The efficacy and toxicity of exemplary bispecific binding proteins of formula (I) Hu106mPSMA-3 and Hu106mPSMA-4 were compared with anti-4-1BB antibody hu106-1 mIgG1 T252M in the CT26-PSMA syngeneic mouse model. Mice bearing CT26-PSMA tumors (100 mm$^3$) were randomized into the following groups (n=8 per group): a murine isotype control group at 10 mg/kg, an anti-4-1BB antibody hu106-1 mIgG1 T252M at 10 mg/kg, and groups for bispecific proteins Hu106mPSMA-3 and Hu106mPSMA-4, each at 10.7 mg/kg to account for the higher molecular weight of the bispecific protein. Dosing of antibody or binding protein was performed three times total at days 18, 20, and 22 post-inoculation. Blood samples were taken at 24 hours after the third dose, and were subject to VetScan analysis for ALT level. Serum cytokines were measured by LUMINEX® cytokine multiplex assay (Millipore).

Subsequent to three doses at 10 mg/kg of the isotype antibody TIB191 mIgG1, the CT26-PSMA tumors continued to grow without significant change to the rate of tumor growth (FIG. 21). By contrast, the groups of mice treated with anti-4-1BB antibody hu106-1 mIgG1 T252M, or with the bispecific binding protein Hu106mPSMA-3 or Hu106mPSMA-4, all exhibited in vivo efficacy as measured by a decrease in the rate of tumor growth as compared to treatment with isotype. Data from individual animals showed a uniform lack of efficacy for the isotype treated animals (FIG. 22A, upper graph), but reduction in the rate of tumor growth in mice treated with antibody hu106-1 mIgG1 T252M (FIG. 22A, lower graph) or the bispecific protein Hu106mPSMA-3 (FIG. 22B, upper graph). Additionally, six out of eight animals exhibited attenuation in the rate of tumor growth after treatment with bispecific protein Hu106mPSMA-4 (FIG. 22B, lower graph).

Proinflammatory cytokine release was measured by serum levels of monocyte chemoattractant protein-1 ("MCP-1"), granulocyte macrophage colony-stimulating factor ("GM-CSF"), interleukin-6 ("IL-6"), and keratinocyte chemoattractant ("KC") after the third and final dose of antibody or binding protein (FIGS. 23A and 23B). The levels of serum MCP-1, GM-CSF, IL-6, and KC were lower after treatment of bispecific protein Hu106mPSMA-3 or Hu106mPSMA-4 as compared with treatment of antibody hu106-1 mIgG1 T252M. For these proinflammatory cytokines, the serum cytokine levels after bispecific protein treatment were comparable to serum levels of the cytokine after treatment with isotype.

Mouse liver samples were also evaluated for CD45+ immune cell infiltration as an indication of potential liver toxicity. Liver samples from mice were harvested and fixed in 10% formalin overnight to be processed and embedded in paraffin blocks. Slides were cut from the blocks and stained with a rat anti-mouse CD45 Ab (Becton Dickenson, #550539) by immunohistochemistry. Stained slides were scanned and CD45 positive immune cells on each scanned image were quantitated by HALO image analysis (Indica Labs, Corrales, N. Mex., USA).

The livers (n=7-9 per group) were collected on day 26 to evaluate immune cell infiltration that may suggest toxicity. Compared to the group treated with antibody hu106-1 mIgG1 T252M, there was decreased CD45+ immune cell infiltration in the livers of the mice treated with Hu106mPSMA-3 and Hu106mPSMA-4 (FIG. 23C).

9. EMBODIMENTS

1. A bispecific binding protein comprising two polypeptides of formula (I):

$$X\text{-}H\text{-}Fc\text{-}L\text{-}scFv^Y \qquad (I),$$

wherein X is $scFv^X$ or a Fab region, X specifically binds a first antigen and $scFv^Y$ specifically binds a second antigen, H is a hinge region, Fc comprises CH2 and CH3 regions of an immunoglobulin, L is a polypeptide linker, $scFv^X$ and $scFv^Y$ are each independently a single chain variable fragment, one of the two antigens is an immunomodulatory protein and the other is a tumor antigen.
2. The bispecific binding protein of embodiment 1, wherein the immunomodulatory protein is one selected from tumor necrosis factor receptor superfamily proteins and CD28 family proteins.
3. The bispecific binding protein of embodiment 1 or 2, wherein the immunomodulatory protein is selected from CD40, 4-1BB, TNFR2, ICOS, TRAILR1, and TRAILR2.
4. The bispecific binding protein of any one of embodiments 1 to 3, wherein the tumor antigen is a cell-surface tumor antigen.
5. The bispecific binding protein of any one of embodiments 1 to 4, wherein the tumor antigen is from brain cancer, breast cancer, gastric cancer, lung cancer, melanoma, ovarian cancer, pancreatic cancer and prostate cancer.
6. The bispecific binding protein of any one of embodiments 1 to 5, wherein the tumor antigen is selected from mesothelin, nectin-4, epidermal growth factor receptor, prostate-specific membrane antigen, and B7-H4.
7. The bispecific binding protein of any one of embodiments 1 to 6, wherein X is $scFv^X$.
8. The bispecific binding protein of embodiment 7, wherein the first antigen is an immunomodulatory protein and the second antigen is a tumor antigen.
9. The bispecific binding protein of embodiment 7 or 8, wherein either $scFv^X$ or $scFv^Y$ comprises a $V_H$ region selected from:

```
EVQLVQSGAEVKKPGSSVKVSCKASGYTFTSYWMHWVRQAPGQGLEWIGNID      (SEQ ID NO: 10)
PSNGETHYNQKFKDRATLTVDKSTSTAYMELSSLRSEDTAVYYCARERIYYSG
STYDGYFDVWGQGTTVTVSS

EVQLVQSGAEVKKPGSSVKVSCKASGYTFTSYWMHWVRQAPGQGLEWIGNID      (SEQ ID NO: 11)
PSNGETHYNQKFKDRVTITVDKSTSTAYMELSSLRSEDTAVYYCARERIYYSGS
TYDGYFDVWGQGTTVTVSS

EVQLVQSGAEVKKPGSSVKVSCKASGYTFTSYWMHWVRQAPGQGLEWIGNID      (SEQ ID NO: 12)
PSNGETHYAQKFQGRVTITVDKSTSTAYMELSSLRSEDTAVYYCARERIYYSGS
TYDGYFDVWGQGTTVTVSS

EVQLVQSGAEVKKPGSSVKVSCKASGYTFTDYYINWVRQAPGQGLEWIGWIFP     (SEQ ID NO: 13)
GSGSVYCNEQFKGRATLTVDRSTSTAYMELSSLRSEDTAVYFCASSLGKFAYW
GQGTLVTVSS

EVQLVQSGAEVKKPGSSVKVSCKASGYTFTDYYINWVRQAPGQGLEWIGWIFP     (SEQ ID NO: 14)
GSGSVYSNEQFKGRATLTVDRSTSTAYMELSSLRSEDTAVYFCASSLGKFAYW
GQGTLVTVSS

EVQLVQSGAEVKKPGSSVKVSCKASGYTFTDYYINWVRQAPGQGLEWIGWIFP     (SEQ ID NO: 15)
GSGSVYCNEQFKGRVTITVDKSTSTAYMELSSLRSEDTAVYYCASSLGKFAYW
GQGTLVTVSS

EVQLQESGPGLVKPSETLSLTCTVSGYSITSNYYWNWIRQPPGKGLEWMGYIRY    (SEQ ID NO: 16)
DGSNNYNPSLKNRITISRDTSKNQFSLKLSSVTAADTAVYYCARLDYWGQGTTV
TVSS

EVQLQESGPGLVKPSETLSLTCTVSGYSITSNYYWNWIRQPPGKGLEWMGYIRY    (SEQ ID NO: 17)
DGSNNYNPSLKNRVTISRDTSKNQFSLKLSSVTAADTAVYYCARLDYWGQGTT
VTVSS

EVQLQESGPGLVKPSETLSLTCTVSGYSISSNYYWNWIRQPPGKGLEWMGYIRY    (SEQ ID NO: 18)
DGSNNYNPSLKSRVTISRDTSKNQFSLKLSSVTAADTAVYYCARLDYWGQGTT
VTVSS

EVQLVESGGGLVKPGETLSLTCTVSGYSITSNYYWNWIRQPPGKGLEWMGYIR     (SEQ ID NO: 19)
YDGSNNYNPSLKGRVTISRDTSKNQFYLKLSSVTAADTAVYYCARLDYWGQGT
TVTVSS

EVQLVESGGGLVQPGGSLRLSCAASGYSITSNYYWNWIRQPPGKGLEWMGYIR     (SEQ ID NO: 20)
YDGSNNYNPSLKGRVTISRDTSKNQLYLKLSSVTAADTAVYYCARLDYWGQG
TLVTVSS

EVQLVESGGGLVKPGETLILTCTVSGYDITSNYYWNWIRQPPGKGLEWMGYIR     (SEQ ID NO: 21)
YDGSNNYNPSLKGRVTISRDTSKNQFYLKLSSVTAADTAVYYCARLDYWGQGT
TVTVSS

QVQLQESGPGLVKPSETLSLTCTVSGYSITSNYYWNWIRQPPGKGLEWMGYIRY    (SEQ ID NO: 22)
DGSNNYNPSLKNRITISRDTSKNQFSLKLSSVTAADTAVYYCARLDYWGQGTLV
TVSS
```

-continued

```
EVQLVESGGGLVQPGGSLRLSCAASGYSITSNYYWNWVRQAPGKGLEWMGYI      (SEQ ID NO: 23)
RYDGSNNYNPSLKNRITISRDTSKNTFYLQMNSLRAEDTAVYYCARLDYWGQG
TLVTVSS
``` and a V_L region selected from:

```
DIQLTQSPSFLSASVGDRVTITCSASSSLSYMHWYQQKPGKSPKRWIYDTSKLA   (SEQ ID NO: 41)
SGVPSRFSGSGSGTEYTLTISSLQPEDFATYYCQQWSSNPWTFGGGTKVEIK

DIQMTQSPSSLSASVGDRVTITCKASQSVVTAVAWYQQKPGKSPKLLIYSASNR   (SEQ ID NO: 42)
YTGVPSRFSGSGSGTDFTLTISSLQPEDFATYFCQQYSSYPYTFGGGTKVEIK

DAVMTQTPLSLSVTPGQPASISCRSSQSLENTNGNTFLNWFLQKPGQSPQLLIY   (SEQ ID NO: 43)
RVSNRFSGVPDRFSGSGSGTDFTLKISRVEAEDVGVYFCLQVTHVPFTFGQGT
KLEIK

DAVMTQTPLSLSVTPGQPASISCRSSQSLENTNGNTFLNWYLQKPGQSPQLLIY   (SEQ ID NO: 44)
RVSNRFSGVPDRFSGSGSGTDFTLKISRVEAEDVGVYYCLQVTHVPFTFGQGT
KLEIK

DAVMTQTPLSLSVTEGQPASISCRSSQSLENTNGNTFLNWYLQKPGQSPQLLIY   (SEQ ID NO: 45)
RVSNRFSGVPDRFSGSGSGTDFTLKISRVEAEDVGVYYCLQVTHVPFTFGQGT
KLEIK

DAVMTQTPLSLAVLPGQPASISCRSSQSLENTNGNTFLNWYLQKPGQSPQLLIY   (SEQ ID NO: 46)
RVSNRFSGVPDRFSGSGSGTDFTLKISRVEAEDVGVYYCLQVTHVPFTFGQGT
KLEIK

DIQMTQSPSSLSASVGDRVTITCRSSQSLENTNGNTFLNWYQQKPGKAPKLLIY   (SEQ ID NO: 47)
RVSNRFSGVPSRFSGSGSGTDFTLTISSLQPEDFATYYCLQVTHVPFTFGQGTK
VEIK

DAVMTQSPLSLPVTLGEPASISCRSSQSLENTNGNTFLNWFQQKPGQSPRLLIY   (SEQ ID NO: 48)
RVSNRFSGVPDRFSGSGSGTDFTLKISRVEAEDVGVYYCLQVTHVPFTFGQGT
KLEIK

DAQMTQSPSSLSASVGDRVTITCRSSQSLENTNGNTFLNWFQQKPGKAPKLLI    (SEQ ID NO: 49)
YRVSNRFSGVPSRFSGSGSGTDFTLTISSLQPEDFATYYCLQVTHVPFTFGQGT
KLEIK

DIVMTQTPLSLSVTPGQPASISCRSSQSLENTNGNTFLNWYLQKPGQSPQLLIY   (SEQ ID NO: 50)
RVSNRFSGVPDRFSGSGSGTDFTLKISRVEAEDVGVYYCLQVTHVPFTFGQGT
KLEIK

DVVMTQTPLSLSVTPGQPASISCRSSQSLENTNGNTFLNWYLQKPGQSPQLLIY   (SEQ ID NO: 51)
RVSNRFSGVPDRFSGSGSGTDFTLKISRVEAEDVGVYYCLQVTHVPFTFGQGT
KLEIK
```

10. The bispecific binding protein of embodiment 7 or 8, wherein either scFv$^X$ or scFv$^Y$ comprises a V$_H$ region selected from:

| Sequence (N→C) | Identifier |
| --- | --- |
| EVQLVQSGAEVKKPGSSVKVSCKASGYTFTSYYIYWVRQAPGQGLEWIGNI WPGNGGTFYGEKFMGRATFTADTSTSTAYMELSSLRSEDTAVYYCARRPD YSGDDYFDYWGQGTLVTVSS | (SEQ ID NO: 69) |
| EVQLVESGGGLVQPGGSLRLSCAASGYTFTSYYIYWVRQAPGKGLEWIGNI WPGNGGTFYGEKFMGRATFSADTSKNTAYLQMNSLRAEDTAVYYCARRP DYSGDDYFDYWGQGTLVTVSS | (SEQ ID NO: 70) |
| EVQLVQSGAEVKKPGSSVKVSCKASDYTENDYWVSWVRQAPGQGLEWIGEI YPNSGATNENGKFRGRATLTVDNSASTAYMELSSLRSEDTAVYYCTREYTR DWFAYWGQGTLVTVSS | (SEQ ID NO: 71) |
| EVQLVESGGGLVQPGGSLRLSCAASGYTENDYWVSWVRQAPGKGLEWIGEI YPNSGATNENGKFRGRATLSVDNSKNTAYLQMNSLRAEDTAVYYCTREYT RDWFAYWGQGTLVTVSS | (SEQ ID NO: 72) | and a V_L region selected from:

| Sequence (N→C) | Identifier |
|---|---|
| NVMLTQPHSVSESPGKTVTISCKLNSGNIGSYYVHWYQQRPGSSPTTMIYRD DKRPDGVPDRFSGSIDSSSNSASLTISGLKTEDEADYYCHSYDSTITPVFGGGT KLTVL | (SEQ ID NO: 89) |
| QVVLTQPPSASGTPGQRVTISCKLNSGNIGSYYVHWYQQLPGTAPKTMIYRD DKRPDGVPDRFSGSSSSNSASLAISGLQSEDEADYYCHSYDSTITPVFGGGTK LTVL | (SEQ ID NO: 90) |
| SVELTQPPSVSVSPGQTARITCKLNSGNIGSYYVHWYQQKPGQAPVTMIYRD DKRPDGIPERFSGSSDSSSNSAFLTISGVQAEDEADYYCHSYDSTITPVFGGGT KLTVL | (SEQ ID NO: 91) |
| EVVLTQPPSLSASPGASARLTCKLNSGNIGSYYVHWYQQKPGSPPRTMIYRD DKRPDGVPSRFSGSKDSSSNSAFLLISGLQSEDEADYYCHSYDSTITPVFGGGT KLTVL | (SEQ ID NO: 92) |
| DVQLTQSPSSLSASVGDRVTITCKLNSGNIGSYYVHWYQQKPGKAPKTMIYR DDKRPDGVPSRFSGSGDSSSNSAFLTISSLQPEDFATYYCHSYDSTITPVFGQG TKVEIK | (SEQ ID NO: 93) |
| DVVLTQSPLSLPVTLGQPASISCRSSQSLLDSDGNTYLYWFQQRPGQSPRRLI YLVSNLGSGVPDRFSGSGSGTDFTLKISRVEAEDVGVYYCMQPTHAPYTFGQ GTKLEIK | (SEQ ID NO: 94) |
| DVQLTQSPSSLSASVGDRVTITCRSSQSLLDSDGNTYLYWFQQKPGKAPKRLI YLVSNLGSGVPSRFSGSGSGTDFTLTISSLQPEDFATYYCMQPTHAPYTFGQG TKVEIK | (SEQ ID NO: 95) |

11. The bispecific binding protein of any one of embodiments 7 to 10, wherein either scFv$^X$ or scFv$^Y$ comprises a V_H region selected from:

| Sequence (N→C) | Identifier |
|---|---|
| EVQLVQSGAEVKEPGASVKVSCKASGDTFNRYYVHWARQAPGQGLEWM GIINPSGVSTTYAQKFQGRVTMTRDTPTNTVYMELGSLRPEDTAVYFCAES RGSGYNYFAMDVWGQGTLVTVSS | (SEQ ID NO: 107) |
| EVQLVQSGAEVKKPGASVKVSCKASGDTFKRYYVQWVRQAPGQGLEWM GIINPSGVSTTYAQKFQGRVTMTRDTSTSTVYMELSSLRSEDTAVYYCAES RGSGYNYFAMDVWGQGTLVTVSS | (SEQ ID NO: 108) |
| EVQLVQSGAEVKKPGASVKVSCKASGYTFKRYYVHWVRQAPGQGLEWM GIINPSGVSTTYAQKFQGRVTMTRDTSTSTVYMELSSLRSEDTAVYYCAES RGSGYNYFAMDVWGQGTLVTVSS | (SEQ ID NO: 109) |
| EVQLVQSGAEVKKPGASVKVSCKASGDTFKRYYVHWVRQAPGQGLEWM GIINPSGVSTTYAQKFQGRVTMTRDTSTSTVYMELSSLRSEDTAVYYCAES RGSGYNYFAMDVWGQGTLVTVSS | (SEQ ID NO: 110) |
| EVQLVQSGAEVKKPGASVKVSCKASGDTFNRYYVHWVRQAPGQGLEWM GIINPSGVSTTYAQKFQGRVTMTRDTSTSTVYMELSSLRSEDTAVYYCAES RIPGYNNFAMDVWGQGTLVTVSS | (SEQ ID NO: 111) |
| EVQLVQSGAEVKKPGASVKVSCKASGDTFNRYYVHWVRQAPGQGLEWM GIINPSGVSTTYAQKFQGRVTMTRDTSTSTVYMELSSLRSEDTAVYYCAEV RGSGYNYFAMDVWGQGTLVTVSS | (SEQ ID NO: 112) |
| EVQLVQSGAEVKKPGASVKVSCKASGDTFNRYYVHWVRQAPGQGLEWM GIINPSGVSTTYAQKFQGRVTMTRDTSTSTVYMELSSLRSEDTAVYYCAES VRVPGYNNFAMDVWGQGTLVTVSS | (SEQ ID NO: 113) |
| EVQLVQSGAEVKKPGASVKVSCKASGDTFNRYYVHWVRQAPGQGLEWM GIINPSGVSTTYAQKFQGRVTMTRDTSTSTVYMELSSLRSEDTAVYYCAEV RGSGYNYFGMDVWGQGTLVTVSS | (SEQ ID NO: 114) |
| EVQLVQSGAEVKKPGASVKVSCKASGDTFNRYYVHWVRQAPGQGLEWM GIINPSGVSTTYAQKFQGRVTMTRDTSTSTVYMELSSLRSEDTAVYYCAES RGSGYNYFAMDVWGQGTLVTVSS | (SEQ ID NO: 115) |
| EVQLVQSGAEVKKPGASVKVSCKASGDTFNRYYVQWVRQAPGQGLEWM GIINPSGVSTTYAQKFQGRVTMTRDTSTSTVYMELSSLRSEDTAVYYCAET RGSGYNYFGMDVWGQGTLVTVSS | (SEQ ID NO: 116) |

-continued

| Sequence (N→C) | Identifier |
|---|---|
| EVQLVQSGAEVKKPGASVKVSCKASGDTFKRYYMHWVRQAPGQGLEWMGIINPSGVSTTYAQKFQGRVTMTRDTSTSTVYMELSSLRSEDTAVYYCAEVRGSGFNYFGMDVWGQGTLVTVSS | (SEQ ID NO: 117) |
| EVQLVQSGAEVKKPGASVKVSCKASGDTFHRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS | (SEQ ID NO: 118) |
| EVQLVQSGAEVKKPGASVKVSCKASGDTFNRYYVQWVRQAPGQGLEWMGIINPSGVSTTYAQKFQGRVTMTRDTSTSTVYMELSSLRSEDTAVYYCAETRGSGFNYFGMDVWGQGTLVTVSS | (SEQ ID NO: 119) |
| EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS | (SEQ ID NO: 120) |
| EVQLVQSGAEVKKPGASVKVSCKASGDTFNRYYVQWVRQAPGQGLEWMGIINPSGVSTTYAQKFQGRVTMTRDTSTSTVYMELSSLRSEDTAVYYCAESRVPGYNIFAMDVWGQGTLVTVSS | (SEQ ID NO: 121) |
| EVQLVQSGAEVKKPGASVKVSCKASGDTFNRYYVHWVRQAPGQGLEWMGIINPSGVSTTYAQKFQGRVTMTRDTSTSTVYMELSSLRSEDTAVYYCAETRGSGYNYFGMDVWGQGTLVTVSS | (SEQ ID NO: 122) |
| EVQLVQSGAEVKKPGASVKVSCKASGDTFKRYYAHWVRQAPGQGLEWMGIINPSGVSTTYAQKFQGRVTMTRDTSTSTVYMELSSLRSEDTAVYYCAESRLPGYNAFAMDVWGQGTLVTVSS | (SEQ ID NO: 123) |
| EVQLVQSGAEVKKPGASVKVSCKASGDTFNRYYVQWVRQAPGQGLEWMGIINPSGVSTTYAQKFQGRVTMTRDTSTSTVYMELSSLRSEDTAVYYCAETRGPGFNYFGMDVWGQGTLVTVSS | (SEQ ID NO: 124) |
| EVQLVQSGAGLVQPGGSVRVSCAASGFTFKRYYVHWVRQAPGKGLEWMGIINPSGVSTTYAQKFQGRVTISRDNSKNTLYMQLNSLRAEDTAVYYCARVRGSGFNYFGMDVWGQGTLVTVSS | (SEQ ID NO: 125) |
| EVQLVESGAGLVKPGESVKVSCAASGFTFKRYYVHWVRQAPGKGLEWMGIINPSGVSTTYAQKFQGRVTISRDNSTNTLYMELNSLRAEDTAVYYCARVRGSGFNYFGMDVWGQGTLVTVSS | (SEQ ID NO: 126) |
| EVQLVESGAGVVKPGESVKVSCAASGFTFKRYYVHWVRQAPGKGLEWMGIINPSGVSTTYAQKFQGRVTMSRDTSTSTVYMELNSLRAEDTAVYYCARVRGSGFNYFGMDVWGQGTLVTVSS | (SEQ ID NO: 127) |
| EVQLVESGGGLVQPGGSLRLSCAASGFTFKRYYVHWVRQAPGKGLEWVGIINPSGVSTTYAQKFQGRFTISRDNSKNTLYLQMNSLRAEDTAVYYCARVRGSGFNYFGMDVWGQGTLVTVSS | (SEQ ID NO: 128) |
| EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSS | (SEQ ID NO: 129) | and a V$_L$ region selected from:

| Sequence (N→C) | Identifier |
|---|---|
| SYELTQPPSVSVSPGQTADITCSGDKLGDKYASWYQQKPGQSPVLVIYQDNRRPSGIPERFSGSNSGNTATLTISGTQAMDEADYYCQAWDSDTYVFGPGTKVTVL | (SEQ ID NO: 136) |
| SYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVL | (SEQ ID NO: 137) |
| SYELTQPPSVSVSPGQTASITCSGDNLGYKYVSWYQQKPGQSPVLVIYQDHRRPSGIPERFSGSNSGNTATLTISGTQAMDEADYYCQAWDTDTYVFGTGTKVTVL | (SEQ ID NO: 138) |
| SYELTQPPSVSVSPGQTASITCSGDKLGDKYASWYQQKPGQSPVLVIYQDNRRPSGIPERFSGSNSGNTATLTISGTQAMDEADYYCQVWDSDTYVFGTGTKVTVL | (SEQ ID NO: 139) |

-continued

| Sequence (N→C) | Identifier |
|---|---|
| SYELTQPPSVSVSPGQTASITCSGDMLGYQYGSWYQQKPGQSPVLVIYQD NRRPSGIPERFSGSNSGNTATLTISGTQAMDEADYYCQAWDGDAFVFGTG TKVTVL | (SEQ ID NO: 140) |
| SYELTQPPSVSVAPGQTARISCSGDKLGDKYASWYQQKPGQAPVLVIYQD NRRPSGIPERFSGSNSGNTATLTISGTQAEDEADYYCQAWDSDTYVFGGG TKLTVL | (SEQ ID NO: 141) |
| DIQMTQSPSSLSASVGDRVTITCSGDKLGDKYASWYQQKPGKAPKLLIYQ DNRRPSGVPSRFSGSGSGTDFTLTISSLQPEDFATYYCQAWDSDTYVFGQG TKVEIK | (SEQ ID NO: 142) |
| DIQMTQSPSSLSASVGDRVTITCRASQSISSYLNWYQQKPGKAPKLLIYAA SSLQSGVPSRFSGSGSGTDFTLTISSLQPEDFATYYCQQSYITPLTFGGGTK VEIK | (SEQ ID NO: 143) |

12. The bispecific binding protein of any one of embodiments 1 to 11, wherein the two polypeptides each comprise the amino acid sequence of any one of SEQ ID NOS: 401, 402, 403, 404, 405, 406, 407, 408, 409, 410, 411, 412, 419, 420, and 421.

13. A polypeptide of formula (II):

$$\text{scFv}^X\text{—H—Fc—L—scFv}^Y \qquad (II),$$

wherein L is a polypeptide linker, H is a hinge region, Fc comprises CH2 and CH3 regions of an immunoglobulin, scFv$^X$ and scFv$^Y$ are each independently a single chain variable fragment, scFv$^X$ specifically binds a first antigen, scFv$^Y$ specifically binds a second antigen, and one of the two antigens is an immunomodulatory protein and the other is a tumor antigen.

14. The polypeptide of embodiment 13, wherein the first antigen is an immunomodulatory protein and the second antigen is a tumor antigen.

15. The polypeptide of embodiment 13 or 14, wherein the immunomodulatory protein is CD40 or 4-1BB.

16. The polypeptide of any one of embodiments 13 to 15, wherein the tumor antigen is selected from mesothelin, nectin-4, epidermal growth factor receptor, prostate-specific membrane antigen, and B7-H4.

17. The polypeptide of any one of embodiments 13 to 16 wherein scFv$^X$— has the structure of formula (V) or (VI):

$$V_H^X\text{—}L^X\text{—}V_L^X\text{—} \qquad (V),$$

$$V_L^X\text{—}L^X\text{—}V_H^X\text{—} \qquad (VI),$$

wherein $V_H^X$ is a variable heavy chain, $V_L^X$ is a variable light chain, and $L^X$ is a polypeptide linker.

18. The polypeptide of any one of embodiments 13 to 17 wherein -scFv$^Y$ has the structure of formula (VII) or (VIII):

$$\text{—}V_L^Y\text{—}L^Y\text{—}V_H^Y \qquad (VII),$$

$$\text{—}V_H^Y\text{—}L^Y\text{—}V_L^Y \qquad (VIII),$$

wherein $V_H^Y$ is a variable heavy chain, $V_L^Y$ is a variable light chain, and $L^Y$ is a polypeptide linker.

19. The polypeptide of any one of embodiments 13 to 18 wherein scFv$^X$— has the structure of formula (V), and —scFv$^Y$ has the structure of formula (VII).

20. The polypeptide of any one of embodiments 13 to 19, wherein the amino acid sequence of $V_H^X$ is: EVQLQES-GPGLVKPSETLSLTCTVSGYSITSNYYWNWIRQPPG-KGLEWMGYIRYDGSNNYN PSLKNRVTISRDTSKN-QFSLKLSSVTAADTAVYYCARLDYWGQGTTVTVSS (SEQ ID NO:17); and the amino acid of $V_L^X$ is DAVMTQT-PLSLSVTPGQPASISCRSSQSLENTNGNTFLNWYLQK-PGQSPQLLIYRVSNRFSG VPDRFSGSGSGTDFTLKIS-RVEAEDVGVYYCLQVTHVPFTFGQGTKLEIK (SEQ ID NO:44).

21. The polypeptide of any one of embodiments 13 to 20, wherein the amino acid sequence of $V_H^Y$ is: EVQLVQS-GAEVKKPGASVKVSCKASGDTFKRYYVH-WVRQAPGQGLEWMGIINPSGVSTT YAQKFQGRVT-MTRDTSTSTVYMELSSLRSEDTAVYYCAEVRGSGF-NYFGMDVWGQGTLV TVSS (SEQ ID NO:120); and the amino acid sequence of $V_L^Y$ is: SYELTQPPSVSVSPGQ-TASITCSGDKLGDKYASWYQQKPGQSPVLVIYQDN-RRPSGIPERFS GSNSGNTATLTISGTQAMDEADYYC-QAWDSDTYVFGTGTKVTVL (SEQ ID NO:137).

22. The polypeptide of any one of embodiments 13 to 21, wherein L has an amino acid sequence comprising: VDGASSPVNVSSPSVQDI (SEQ ID NO:251); VDGASSPVNVGSPSVQDI (SEQ ID NO:253); GASSPVNVSSPSV (SEQ ID NO:254); GGGGSGGGNGTGSGGGGS (SEQ ID NO:255); LSAG-GHGGLDNDTSAFHL (SEQ ID NO:256); SDKTHTSPPS-PAPESSGG (SEQ ID NO:257); VTTTDFQIQTEMAAT-MET (SEQ ID NO:258); DFLPTTAQPTKKSTLKKR (SEQ ID NO:259); TESRSPPAENEVSTPMQA (SEQ ID NO:260); GGGGSGGGNGSGSGGGGS (SEQ ID NO:261); or GGGGSGGGSGGGSGGGGS (SEQ ID NO:262).

23. The polypeptide of any one of embodiments 13 to 22, wherein $L^X$ and $L^Y$ each has an amino acid sequence comprising: GGGGSGGGGSGGGGS (SEQ ID NO:301); GGGGSGGGGSGGGGSGGGGS (SEQ ID NO:302); GGGGSGGGGSGGGGSGGGGSGGGGS (SEQ ID NO:303); GGGGSGGGGSGGGGSGGGGSGGGGSGGGGS (SEQ ID NO:304); GGGGSGGGGSGGGGSGGGGSGGGGSGGGGSGGGGS (SEQ ID NO:305); or GGGGSGGGGSGGGGSGGGGSGGGGSGGGGSGG-GGSGGGGS (SEQ ID NO:306).

24. A polypeptide of formula (III):

$$\text{Fab—H—Fc—L—scFv}^Y \qquad (III),$$

wherein L is a polypeptide linker, H is a hinge region, Fc comprises CH2 and CH3 regions of an immunoglobulin, Fab is a fragment antigen-binding region, scFv$^Y$ is a single chain variable fragment, Fab specifically binds a first antigen, scFv$^Y$ specifically binds a second antigen, and the first antigen is a tumor antigen and the second antigen is an immunomodulatory protein.

25. A polypeptide of formula (IV):

$$V_H\text{—}CH1\text{—}H\text{—}Fc\text{—}L\text{—}scFv^Y \quad (IV),$$

wherein L is a polypeptide linker, $V_H$—CH1, when combined with a peptide comprising $V_L$—CL, specifically binds a first antigen, CH1 is a CH1 constant domain, CL is a light chain constant domain, H is a hinge region, Fc comprises CH2 and CH3 regions of an immunoglobulin, $V_H$ is a variable heavy chain, $V_L$ is a variable light chain, $scFv^Y$ is a single chain variable fragment, $scFv^Y$ specifically binds a second antigen, and the first antigen is a tumor antigen and the second antigen is an immunomodulatory protein.

26. The polypeptide of embodiment 24 or 25 wherein —$scFv^Y$ has the structure of formula (VII) or (VIII):

$$-V_L^Y\text{—}L^Y\text{—}V_H^Y \quad (VII),$$

$$-V_H^Y\text{—}L^Y\text{—}V_L^Y \quad (VIII),$$

wherein $V_H^Y$ is a variable heavy chain, $V_L^Y$ is a variable light chain, and $L^Y$ is a polypeptide linker.

27. The polypeptide of embodiment 26, wherein the amino acid sequence of $V_H^Y$ is: EVQLQESGPGLVKPSETLSLTCTVSGYSITSNYYWNWIRQPPGKGLEWMGYIRYDGSNNYN PSLKNRVTISRDTSKNQFSLKLSSVTAADTAVYYCARLDYWGQGTTVTVSS (SEQ ID NO:17); and the amino acid sequence of $V_L^Y$ is DAVMTQTPLSLSVTPGQPASISCRSSQSLENTNGNTFLNWYLQKPGQSPQLLIYRVSNRFSG VPDRFSGSGSGTDFTLKISRVEAEDVGVYYCLQVTHVPFTFGQGTKLEIK (SEQ ID NO:44).

28. The polypeptide of embodiment 26 or 27, wherein L has an amino acid sequence comprising: VDGASSPVNVSSPSVQDI (SEQ ID NO:251); VDGASSPVNVGSPSVQDI (SEQ ID NO:253); GASSPVNVSSPSV (SEQ ID NO:254); GGGGSGGGNGTGSGGGGS (SEQ ID NO:255); LSAGGHGGLDNDTSAFHL (SEQ ID NO:256); SDKTHTSPPSPAPESSGG (SEQ ID NO:257); VTTTDFQIQTEMAATMET (SEQ ID NO:258); DFLPTTAQPTKKSTLKKR (SEQ ID NO:259); TESRSPPAENEVSTPMQA (SEQ ID NO:260); GGGGSGGGNGSGSGGGGS (SEQ ID NO:261); or GGGGSGGGSGGGSGGGGS (SEQ ID NO:262).

29. The polypeptide of any one of embodiments 26 to 28, wherein $L^Y$ has an amino acid sequence comprising: GGGGSGGGGSGGGGS (SEQ ID NO:301); GGGGSGGGGSGGGGSGGGGS (SEQ ID NO:302); GGGGSGGGGSGGGGSGGGGSGGGGS (SEQ ID NO:303); GGGGSGGGGSGGGGSGGGGSGGGGSGGGGS (SEQ ID NO:304); GGGGSGGGGSGGGGSGGGGSGGGGSGGGGSGGGGS (SEQ ID NO:305); or GGGGSGGGGSGGGGSGGGGSGGGGSGGGGSGGGGSGGGGS (SEQ ID NO:306).

30. The polypeptide of any one of embodiments 1 to 29, wherein the Fc comprises a CH2 region from an $IgG_1$, $IgG_2$, or $IgG_4$.

31. The polypeptide of embodiment 30, wherein the CH2 region is a variant human $IgG_1$ comprising the amino acid substitution V263L or V273E.

32. The polypeptide of any one of embodiments 1 to 31, wherein H is a variant $IgG_1$ hinge that comprises the amino acid substitution C220S.

33. The polypeptide of any one of embodiments 1 to 32, wherein Fc comprises the amino acid substitutions D356E and L358M.

34. A pharmaceutical composition comprising a bispecific binding protein of any one of embodiments 1 to 12, and a pharmaceutically acceptable carrier.

35. A nucleic acid comprising a nucleotide sequence encoding a bispecific binding protein of any one of embodiments 1 to 12.

36. A vector comprising the nucleic acid of embodiment 35.

37. A prokaryotic host cell transformed with the vector of embodiment 36.

38. A eukaryotic host cell transformed with the vector of embodiment 36.

39. A eukaryotic host cell engineered to express the nucleic acid of embodiment 35.

40. The eukaryotic host cell of embodiment 39 which is a mammalian host cell.

41. A method of producing a bispecific binding protein, comprising: (a) culturing the host cell of embodiment 38 or embodiment 39 and (b) recovering the protein.

42. A method of activating the immune system, comprising administering to a patient in need thereof a bispecific binding protein of any one of embodiment 1 to 12, or a pharmaceutical composition according to embodiment 34.

43. A method of treating a cancer, comprising administering to a patient in need thereof a bispecific binding protein of any one of embodiments 1 to 12, or a pharmaceutical composition according to embodiment 34.

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (448 sequences)

SEQ ID NO: 1 - protein, 116 aa, Artificial Sequence
  Description of Artificial Sequence: Synthetic polypeptide
QVQLQQPGAELVKPGASVKMSCKASGYTFTSYWITWVKQRPGQGLEWIGEINPGSGSTNYNEKFKSKATLTVDTSSSTAYMQLSSLTSEDSAVYYCARNRGTGDYWGQGTTLTVSS

SEQ ID NO: 2 - protein, 114 aa, Artificial Sequence
  Description of Artificial Sequence: Synthetic polypeptide
QVQLQQSGAELMKPGASAKLSCKATGYTFTGYWIQWVKQRPGHGLEWIGEILPGGDHTKYNEKFRGKATFTSDTSSNTVYMQLSSLTTEDSAIYYCARVGGDYWGQGTTLTVSS

SEQ ID NO: 3 - protein, 122 aa, Artificial Sequence
  Description of Artificial Sequence: Synthetic polypeptide
EVQLQQSGPELVKPGASVKISCKASGYTFTDYYMNWVKQSHGKSLEWIGDINPNNGGTSYNQKFKGKATLTVDKSSSTAYMELRSLTSEDSAVYYCARRGGLGRGTYALDYWGQGTSVTVSS

SEQ ID NO: 4 - protein, 113 aa, Artificial Sequence
  Description of Artificial Sequence: Synthetic polypeptide
LVQPGGSLSLSCAASGFTFSDYYMSWVRQPPGKALEWLGFIRNKANGYTTEFSASVKGRFTISRDNSQSILYLQMNALRAEDSATYYCARYGGLRQGWYFDVWGTGTTVTVSS

SEQ ID NO: 5 - protein, 112 aa, Artificial Sequence
  Description of Artificial Sequence: Synthetic polypeptide
DVQLQESGPGLVEPSQSLFLTCSVTGYSITTNYNWNWIRQFPGNKLEWMGYIRHDGTNNYNPSLKNRISIIRDTPKNQFFLKLNSVTTEDTAIYFCTRLDYWGQGTSVTVSS

SEQ ID NO: 6 - protein, 125 aa, Artificial Sequence
  Description of Artificial Sequence: Synthetic polypeptide
QVQLQQPGAELVRPGSSVKLSCKASGYTFTSYWMHWVKQRPIQGLEWIGNIDPSNGETHYNQKFKDKATLTVDKSSSTAYMQLSSLTSEDSAVYYCARERIYYSGSTYDGYFDVWGTGTTVTVSS

SEQ ID NO: 7 - protein, 116 aa, Artificial Sequence
  Description of Artificial Sequence: Synthetic polypeptide
QVQLQQSGPELVKSGASVKISCKASGYTFTDYYINWVKQRPGQGLEWIGWIFPGSGSVYCNEQFKGQATLTVDRSSSTAYMLLSSLTSEDSAVYFCASSLGKFAYWGQGTLVTVSA

SEQ ID NO: 8 - protein, 112 aa, Artificial Sequence
  Description of Artificial Sequence: Synthetic polypeptide
DVQLQESGPGLVKPSQSLSLTCSVTGYSITSNYYWNWIRQFPGNKLEWMGYIRYDGSNNYNPSLKNRISITRDTSKNQFFLKLNSVTTEDTATYYCARLDYWGQGTTLTVSS

SEQ ID NO: 9 - protein, 112 aa, Artificial Sequence
  Description of Artificial Sequence: Synthetic polypeptide
DVQLQESGPGLVKPSQSLSLTCSVTGYSITSNYYWNWIRQFPGNKLEWMGYIRYDGSNNYNPSLKNRISITRDTSKNQFFLRLNSVTTEDTATYYCTRLDYWGQGTTLTVSS

SEQ ID NO: 10 - protein, 125 aa, Artificial Sequence
  Description of Artificial Sequence: Synthetic polypeptide
EVQLVQSGAEVKKPGSSVKVSCKASGYTFTSYWMHWVRQAPGQGLEWIGNIDPSNGETHYNQKFKDRATLTVDKSTSTAYMELSSLRSEDTAVYYCARERIYYSGSTYDGYFDVWGQGTTVTVSS

SEQ ID NO: 11 - protein, 125 aa, Artificial Sequence
  Description of Artificial Sequence: Synthetic polypeptide
EVQLVQSGAEVKKPGSSVKVSCKASGYTFTSYWMHWVRQAPGQGLEWIGNIDPSNGETHYNQKFKDRVTITVDKSTSTAYMELSSLRSEDTAVYYCARERIYYSGSTYDGYFDVWGQGTTVTVSS

SEQ ID NO: 12 - protein, 125 aa, Artificial Sequence
  Description of Artificial Sequence: Synthetic polypeptide
EVQLVQSGAEVKKPGSSVKVSCKASGYTFTSYWMHWVRQAPGQGLEWIGNIDPSNGETHYAQKFQGRVTITVDKSTSTAYMELSSLRSEDTAVYYCARERIYYSGSTYDGYFDVWGQGTTVTVSS

SEQ ID NO: 13 - protein, 116 aa, Artificial Sequence
  Description of Artificial Sequence: Synthetic polypeptide
EVQLVQSGAEVKKPGSSVKVSCKASGYTFTDYYINWVRQAPGQGLEWIGWIFPGSGSVYCNEQFKGRATLTVDRSTSTAYMELSSLRSEDTAVYFCASSLGKFAYWGQGTLVTVSS

SEQ ID NO: 14 - protein, 116 aa, Artificial Sequence
  Description of Artificial Sequence: Synthetic polypeptide
EVQLVQSGAEVKKPGSSVKVSCKASGYTFTDYYINWVRQAPGQGLEWIGWIFPGSGSVYSNEQFKGRATLTVDRSTSTAYMELSSLRSEDTAVYFCASSLGKFAYWGQGTLVTVSS

SEQ ID NO: 15 - protein, 116 aa, Artificial Sequence
  Description of Artificial Sequence: Synthetic polypeptide
EVQLVQSGAEVKKPGSSVKVSCKASGYTFTDYYINWVRQAPGQGLEWIGWIFPGSGSVYCNEQFKGRVTITVDKSTSTAYMELSSLRSEDTAVYYCASSLGKFAYWGQGTLVTVSS

SEQ ID NO: 16 - protein, 112 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRITISRDTSKNQFSLKLSSVTAADTAVYYCARLDYWGQGTTVTVSS

SEQ ID NO: 17 - protein, 112 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSS

SEQ ID NO: 18 - protein, 112 aa, Artificial Sequence
  Description of Artificial Sequence: Synthetic polypeptide
EVQLQESGPGLVKPSETLSLTCTVSGYSISSNYYWNWIRQPPGKGLEWMGYIRYDGSNNYNPSLKSRVTISRDTSKNQFSLKLSSVTAADTAVYYCARLDYWGQGTTVTVSS

SEQ ID NO: 19 - protein, 112 aa, Artificial Sequence
  Description of Artificial Sequence: Synthetic polypeptide
EVQLVESGGGLVKPGETLSLTCTVSGYSITSNYYWNWIRQPPGKGLEWMGYIRYDGSNNYNPSLKGRVTISRDTSKNQFYLKLSSVTAADTAVYYCARLDYWGQGTTVTVSS

SEQ ID NO: 20 - protein, 112 aa, Artificial Sequence
  Description of Artificial Sequence: Synthetic polypeptide
EVQLVESGGGLVQPGGSLRLSCAASGYSITSNYYWNWIRQPPGKGLEWMGYIRYDGSNNYNPSLKGRVTISRDTSKNQLYLKLSSVTAADTAVYYCARLDYWGQGTLVTVSS

SEQ ID NO: 21 - protein, 112 aa, Artificial Sequence
  Description of Artificial Sequence: Synthetic polypeptide
EVQLVESGGGLVKPGETLILTCTVSGYDITSNYYWNWIRQPPGKGLEWMGYIRYDGSNNYNPSLKGRVTISRDTSKNQFYLKLSSVTAADTAVYYCARLDYWGQGTTVTVSS

SEQ ID NO: 22 - protein, 112 aa, Artificial Sequence
  Description of Artificial Sequence: Synthetic polypeptide
QVQLQESGPGLVKPSETLSLTCTVSGYSITSNYYWNWIRQPPGKGLEWMGYIRYDGSNNYNPSLKNRITISRDTSKNQFSLKLSSVTAADTAVYYCARLDYWGQGTLVTVSS

SEQ ID NO: 23 - protein, 112 aa, Artificial Sequence
  Description of Artificial Sequence: Synthetic polypeptide
EVQLVESGGGLVQPGGSLRLSCAASGYSITSNYYWNWVRQAPGKGLEWMGYIRYDGSNNYNPSLKNRITISRDTSKNTFYLQMNSLRAEDTAVYYCARLDYWGQGTLVTVSS

SEQ ID NO: 24 - skipped

SEQ ID NO: 25 - protein, 11 aa, Artificial Sequence
  Description of Artificial Sequence: Synthetic peptide
GYSITSNYYWN

SEQ ID NO: 26 - protein, 16 aa, Artificial Sequence
  Description of Artificial Sequence: Synthetic peptide
YIRYDGSNNYNPSLKN

SEQ ID NO: 27 - protein, 3 aa, Artificial Sequence
  Description of Artificial Sequence: Synthetic peptide
LDY

SEQ ID NO: 28-30 - skipped (3 entries)

SEQ ID NO: 31 - protein, 112 aa, Artificial Sequence
  Description of Artificial Sequence: Synthetic polypeptide
DVVMTQTPLSLPVSLGDQASISCRSSQSLVHSYGNTYLHWYLQKPGQSPKFLIYKVSNRISGVPDRLSGSGSGTDFTLKISRVEPEDLGVYFCSQSTHVPYTFGGGTKLEIK

SEQ ID NO: 32 - protein, 112 aa, Artificial Sequence
  Description of Artificial Sequence: Synthetic polypeptide
DVVMTQTPLSLPVSLGDQASISCRSSQSLVNSNENTYLHWYLQKPGQSPKLLIYKVFNRYSGVPDRFSGSGSGTDFTLKISRVEAEDLGVYFCFQSTHVPWTFGGGTKLEIK

SEQ ID NO: 33 - protein, 107 aa, Artificial Sequence
  Description of Artificial Sequence: Synthetic polypeptide
DIQMTQTTSSLSASLGDRVTISCRASQDISNYLNWYQQKPDGTVKPLIYYTSRLHLGVPSRFSGSGSGTDYSLTISNLEQEDIATYFCQQGNTLPLTFGAGTKLELK

SEQ ID NO: 34 - protein, 107 aa, Artificial Sequence
  Description of Artificial Sequence: Synthetic polypeptide
DIQMTQTTSSLSASLGDRVTISCRASQDIRNYLNWYQQKPDGTVKLLIYYTSRLHSGVPSRFSGSGSGTDYSLTISNLEQEDIATYFCQQGKTLPWTFGGGSKLEMK

SEQ ID NO: 35 - protein, 112 aa, Artificial Sequence
  Description of Artificial Sequence: Synthetic polypeptide
DAVMTQTPLSLPVSLGDQASISCRSSQSLENSYGNTFLNWFLQRPGQSPQLLIYRVSNRFCGVPDRFSGSGSGTDFTLKISRVEAEDLGIYFCLQVTHVPYTFGGGTKLEIK

SEQ ID NO: 36 - protein, 106 aa, Artificial Sequence
  Description of Artificial Sequence: Synthetic polypeptide
QIVLTQSPAIMSASPGEKVTMTCSASSSLSYMHWYQQKSGTSPKRWIYDTSKLASGVPARFSGSGSGTSYSLTISSMEAEDAATYYCQQWSSNPWTFGGGTKLEIK

SEQ ID NO: 37 - protein, 106 aa, Artificial Sequence
  Description of Artificial Sequence: Synthetic polypeptide
QIVLTQSPAIMSASPGEKVTMTCSASSSLSYMHWYQQKSGTSPKRWIYDTSKLASGVPARFSGSGSGTSYSLTISSMEGEDGATYYCQQWSSNPWTFGGGTKLEIK

SEQ ID NO: 38 - protein, 107 aa, Artificial Sequence
  Description of Artificial Sequence: Synthetic polypeptide
DIVMTQSQKFMSTTVGDRVSITCKASQSVVTAVAWYQQKPGQSPKLLIYSASNRYTGVPDRFTGSGSGTDFALTIRTMQSEDLADYFCQQYSSYPYTFGGGTKLEIK

SEQ ID NO: 39 - protein, 112 aa, Artificial Sequence
  Description of Artificial Sequence: Synthetic polypeptide
DAVMTQTPLSLPVSLGDQASISCRSSQSLENTNGNTFLNWFLQKPGQSPQLLIYRVSNRFSGVPDRFSGSGSGTDFTLKISRVEAEDLGVYFCLQVTHVPFTFGSGTKLEIK

SEQ ID NO: 40 - protein, 112 aa, Artificial Sequence
  Description of Artificial Sequence: Synthetic polypeptide
DAVMTQTPLSLPVSLGDQASISCRSSQSLENSNGNTFLNWFLQKPGQSPQLLIYRISNRFSGVPDRFSGSGSGTDFTLKISRVEAEDLGVYFCLQVTHVPFTFGSGTKLEIK

SEQ ID NO: 41 - protein, 106 aa, Artificial Sequence
  Description of Artificial Sequence: Synthetic polypeptide
DIQLTQSPSFLSASVGDRVTITCSASSSLSYMHWYQQKPGKSPKRWIYDTSKLASGVPSRFSGSGSGTEYTLTISSLQPEDFATYYCQQWSSNPWTFGGGTKVEIK

SEQ ID NO: 42 - protein, 107 aa, Artificial Sequence
  Description of Artificial Sequence: Synthetic polypeptide
DIQMTQSPSSLSASVGDRVTITCKASQSVVTAVAWYQQKPGKSPKLLIYSASNRYTGVPSRFSGSGSGTDFTLTISSLQPEDFATYFCQQYSSYPYTFGGGTKVEIK

SEQ ID NO: 43 - protein, 112 aa, Artificial Sequence
  Description of Artificial Sequence: Synthetic polypeptide
DAVMTQTPLSLSVTPGQPASISCRSSQSLENTNGNTFLNWFLQKPGQSPQLLIYRVSNRFSGVPDRFSGSGSGTDFTLKISRVEAEDVGVYFCLQVTHVPFTFGQGTKLEIK

SEQ ID NO: 44 - protein, 112 aa, Artificial Sequence
  Description of Artificial Sequence: Synthetic polypeptide
DAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIK

SEQ ID NO: 45 - protein, 112 aa, Artificial Sequence
  Description of Artificial Sequence: Synthetic polypeptide
DAVMTQTPLSLSVTEGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIK

SEQ ID NO: 46 - protein, 112 aa, Artificial Sequence
  Description of Artificial Sequence: Synthetic polypeptide
DAVMTQTPLSLAVLPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIK

SEQ ID NO: 47 - protein, 112 aa, Artificial Sequence
  Description of Artificial Sequence: Synthetic polypeptide
DIQMTQSPSSLSASVGDRVTITCRSSQSLENTNGNTFLNWYQQKPGKAPKLLIYRVSNRFSGVPSRFSGSGSGTDFTLTISSLQPEDFATYYCLQVTHVPFTFGQGTKVEIK

SEQ ID NO: 48 - protein, 112 aa, Artificial Sequence
  Description of Artificial Sequence: Synthetic polypeptide
DAVMTQSPLSLPVTLGEPASISCRSSQSLENTNGNTFLNWFQQKPGQSPRLLIYRVSNRFSGVPDRFSGSGSGTDFTLKISRVEAEDVGVYYCLQVTHVPFTFGQGTKLEIK

SEQ ID NO: 49 - protein, 112 aa, Artificial Sequence
  Description of Artificial Sequence: Synthetic polypeptide
DAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIK

SEQ ID NO: 50 - protein, 112 aa, Artificial Sequence
  Description of Artificial Sequence: Synthetic polypeptide
DIVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIK

SEQ ID NO: 51 - protein, 112 aa, Artificial Sequence
  Description of Artificial Sequence: Synthetic polypeptide
DVVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIK

SEQ ID NO: 52-54 - skipped (3 entries)

SEQ ID NO: 55 - protein, 16 aa, Artificial Sequence
  Description of Artificial Sequence: Synthetic peptide
RSSQSLENTNGNTFLN

SEQ ID NO: 56 - protein, 7 aa, Artificial Sequence
  Description of Artificial Sequence: Synthetic peptide
RVSNRFS

SEQ ID NO: 57 - protein, 9 aa, Artificial Sequence
  Description of Artificial Sequence: Synthetic peptide
LQVTHVPFT

SEQ ID NO: 58-60 - skipped (3 entries)

SEQ ID NO: 61 - protein, 116 aa, Artificial Sequence
  Description of Artificial Sequence: Synthetic polypeptide
QIQLVQSGPELKKPGESVKISCKASGYTFTDFAIHWVKQAPGKGLKWMGWINTYTGKPTYADDFKGRFVFSLEASASTANLQISNLKNEDTATYFCSRGAPRPTNWGQGTLVTVSS

SEQ ID NO: 62 - protein, 119 aa, Artificial Sequence
  Description of Artificial Sequence: Synthetic polypeptide
QVQLQQSGAELAKPGSSVKISCKASGYTLTSYYLNWIKQTTGQGLEYIGYIDTGSGGSHYNEKFKGKATLTVDKSSSTAFMQLSSLTPVDSAVYYCARGGYYDGFFDYWGQGVMVTVSS

SEQ ID NO: 63 - protein, 126 aa, Artificial Sequence
  Description of Artificial Sequence: Synthetic polypeptide
QVQLQQSGAELVKPGSSVKISCKASDYTFTSNFLHWIKQQPGNGLEWIGWINPGDGDTYYNQKFNGKATLTADKSSTTAYMQLSSLTSEDSAVYFCAGGNYYAAHYPPGPWYFDFWGPGTMVTVSS

SEQ ID NO: 64 - protein, 120 aa, Artificial Sequence
  Description of Artificial Sequence: Synthetic polypeptide
QVTLKESGPGILQPSQTLSLTCTFSGFSLSTDGLGVTWIRQPSGKGLEWLANIWWDDDKDYNPSLKNRLTISKDTSNPQAFLKITNVDTADTATYYCARIVPNSGHEDYWGQGVMVIVSS

SEQ ID NO: 65 - protein, 117 aa, Artificial Sequence
  Description of Artificial Sequence: Synthetic polypeptide
EVQLVESGGGLVQPGRSMKLSCAASGFTFNNYDMAWVCQAPKRGLEWVATISYDGSTTYYRDSVKGRFTFSRDNAKSTLYLQMDSLRSEDTATYYCARVGAGDFDYWGQGVMVTVSS

SEQ ID NO: 66 - protein, 121 aa, Artificial Sequence
  Description of Artificial Sequence: Synthetic polypeptide
QVQLQQSGAELAKPGTSVKLSCKASGYTFTSYYIYWVKQRPGQGLEWIGNIWPGNGGTFYGEKFMGKATFTADTSSSTAYMLLGSLTPEDSAYYFCARRPDYSGDDYFDYWGQGVLVTVSS

SEQ ID NO: 67 - protein, 118 aa, Artificial Sequence
  Description of Artificial Sequence: Synthetic polypeptide
QVKLVQSGAALVKPGASVKMSCKASDYTFNDYWVSWVKQRHGESLEWIGEIYPNSGATNFNGKFRGKATLTVDNPTSTAYMELSRLTSEDSAIYYCTREYTRDWFAYWGQGTLVTVSS

SEQ ID NO: 68 - protein, 120 aa, Artificial Sequence
  Description of Artificial Sequence: Synthetic polypeptide
EIQLQESGPGLVRPSQSLSLACSVTGYTITSAYDWSWIRKFPGNKMEWMGYIAYIGFTNSNPSLKSRISITRDTSKNQFFLQLKSVTTEDTATYYCARWSSYIPRYFDFWGPGTMVTVSS

SEQ ID NO: 69 - protein, 121 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSS

SEQ ID NO: 70 - protein, 121 aa, Artificial Sequence
  Description of Artificial Sequence: Synthetic polypeptide
EVQLVESGGGLVQPGGSLRLSCAASGYTFTSYYIYWVRQAPGKGLEWIGNIWPGNGGTFYGEKFMGRATFSADTSKNTAYLQMNSLRAEDTAVYYCARRPDYSGDDYFDYWGQGTLVTVSS

SEQ ID NO: 71 - protein, 118 aa, Artificial Sequence
  Description of Artificial Sequence: Synthetic polypeptide
EVQLVQSGAEVKKPGSSVKVSCKASDYTFNDYWVSWVRQAPGQGLEWIGEIYPNSGATNFNGKFRGRATLTVDNSASTAYMELSSLRSEDTAVYYCTREYTRDWFAYWGQGTLVTVSS

SEQ ID NO: 72 - protein, 118 aa, Artificial Sequence
  Description of Artificial Sequence: Synthetic polypeptide
EVQLVESGGGLVQPGGSLRLSCAASGYTFNDYWVSWVRQAPGKGLEWIGEIYPNSGATNFNGKFRGRATLSVDNSKNTAYLQMNSLRAEDTAVYYCTREYTRDWFAYWGQGTLVTVSS

SEQ ID NO: 73 - protein, 124 aa, Artificial Sequence
  Description of Artificial Sequence: Synthetic polypeptide
EVQLVESGGDLVKPGGSQKLSCAASGFTFSSYGMSWVRQTPDRRLEWVAAIISGGSYTYYPDSVKGRFTISRDNAKNTLYLQMNSLKSEDTAMYYCARHGGYDGNYDYYAMDYWGQGTSVTVSS

SEQ ID NO: 74 - protein, 114 aa, Artificial Sequence
  Description of Artificial Sequence: Synthetic polypeptide
GVQLVESGGGLVQPGGSRKLSCAASGFTFSSFGMHWFRQAPEKGLEWVAYISSGSSTIYYADTLKGRFTISRDNPKNTLFLQMTSLRSEDTAMYYCARDWVDYWGQGTTLTVSS

SEQ ID NO: 75 - protein, 120 aa, Artificial Sequence
  Description of Artificial Sequence: Synthetic polypeptide
EVQLQQSGAELVRPGASVKLSCTASGFNIKDYYMHWVKQRPEQGLEWIGRIDPEDGDTEYVPKFQGKATMTADTSSNTAYLQLSSLTSEDTAVYYCTPYSNYVYWYFDVWGTGTTVTVSS

SEQ ID NO: 76 - protein, 120 aa, Artificial Sequence
  Description of Artificial Sequence: Synthetic polypeptide
EVQLQQSGAELVRPGASVKLSCTASGFNIKDYYMHWVKQRPEQGLEWIGRIDPEDGDTEYAPKFQGKATMTADTSSNTAYLQLSTLTSEDTAVYYCTPYSNYVYWYFDVWGTGTTVTVSS

SEQ ID NO: 77 - protein, 118 aa, Artificial Sequence
  Description of Artificial Sequence: Synthetic polypeptide
QVQLKQSGPGLVQPSQSLSITCTVSGFSLTSYGVHWVRQSPGKGLEWLGMIWSGGSTDYNAAFISRLSISKDNSKSQVFFKMNSLQADDTALYFCASYGGFYETMDYWGQGTSVTVSS

SEQ ID NO: 78 - protein, 121 aa, Artificial Sequence
  Description of Artificial Sequence: Synthetic polypeptide
QIQLVQSGPELKKPGETVKISCKASGYTFTTYGMSWVKQAPGKGLKWMGWINTYSGVPTYADDFKGRFAFSLETSASTAYLQINNLKNEDTATYFCARGNDGNYYGWFAHWGQGTLVTVSA

SEQ ID NO: 79-80 - skipped (2 entries)

SEQ ID NO: 81 - protein, 107 aa, Artificial Sequence
  Description of Artificial Sequence: Synthetic polypeptide
DIQMTQSPASLSASLGETVSIECLASEDIYNNLAWYQQKPGKSPQLLIYYESRLQDGVPTRFSGSGSGTQYSLKINSLESEDAATYFCLQDSEYPYTFGAGTKLELK

SEQ ID NO: 82 - protein, 107 aa, Artificial Sequence
  Description of Artificial Sequence: Synthetic polypeptide
DIQMTQSPASLSASLGETVSIECLASEGISNDLAWYQQKSGKSPQFLIYAASRLQDGVPSRFSGSGSGTRYSLKISGMQPEDEADYFCQQSYKYPPTFGSGTKLEIK

SEQ ID NO: 83 - protein, 106 aa, Artificial Sequence
  Description of Artificial Sequence: Synthetic polypeptide
DTVLTQSPALAVSLGQRVTISCRASKSVSIYMHWYQQKSGQQPKFLIYTASNLESGVPSRFSGSGSGTDFTLTIDPVEADDIANYYCQQSNELPFTFGSGTKLEIK

SEQ ID NO: 84 - protein, 107 aa, Artificial Sequence
  Description of Artificial Sequence: Synthetic polypeptide
DIQMTQSPSFLSASVGDRVTINCKASQNINRYLNWYQQKLGEAPKLLMYNTNSMQTGIPSRFSGSGSGTDFTLTISSLQPEDVATYFCLQHNSWPRTFGGGTKLELK

SEQ ID NO: 85 - protein, 107 aa, Artificial Sequence
  Description of Artificial Sequence: Synthetic polypeptide
DIRMTQSPVSLSTSLGETVNIECLASEDIYSDLAWYQQKPGKSPQLLIYSTNTLQNGVPSRFSGSGSGTQYSLKINSLQSEDVATYFCQQNNNYPYTFGAGTKLELK

SEQ ID NO: 86 - protein, 111 aa, Artificial Sequence
  Description of Artificial Sequence: Synthetic polypeptide
QVVLTQPKSVSTSLKSTVKLSCKLNSGNIGSYYVHWYQQHAGRSPTTMIYRDDKRPDGVPDRFSGSIDSSSNSAFLTINNVQTEDDAIYFCHSYDSTITPVFGGGTKLTVL

SEQ ID NO: 87 - protein, 112 aa, Artificial Sequence
  Description of Artificial Sequence: Synthetic polypeptide
DVVLTQTPSILSATIGQSVSISCRSSQSLLDSDGNTYLYWFLQRPGQSPQRLIYLVSNLGSGVPNRFSGSGSGTDFTLKISGVEAEDLGIYYCMQPTHAPYTFGAGTKLELK

SEQ ID NO: 88 - protein, 110 aa, Artificial Sequence
  Description of Artificial Sequence: Synthetic polypeptide
QAVLTQPNSVSTSLGSTVKLSCTITSGNIEDNFVHWYQHYEGRSPTTMIHNDDKRPDGVPDRFSGSIDSSSNSAFLTINNVEIEDEAIYFCHSYVSSINIFGGGTKLTVL

SEQ ID NO: 89 - protein, 111 aa, Artificial Sequence
  Description of Artificial Sequence: Synthetic polypeptide
NVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVL

SEQ ID NO: 90 - protein, 109 aa, Artificial Sequence
  Description of Artificial Sequence: Synthetic polypeptide
QVVLTQPPSASGTPGQRVTISCKLNSGNIGSYYVHWYQQLPGTAPKTMIYRDDKRPDGVPDRFSGSSSSNSASLAISGLQSEDEADYYCHSYDSTITPVFGGGTKLTVL

SEQ ID NO: 91 - protein, 111 aa, Artificial Sequence
  Description of Artificial Sequence: Synthetic polypeptide
SVELTQPPSVSVSPGQTARITCKLNSGNIGSYYVHWYQQKPGQAPVTMIYRDDKRPDGIPERFSGSSDSSSNSAFLTISGVQAEDEADYYCHSYDSTITPVFGGGTKLTVL

SEQ ID NO: 92 - protein, 111 aa, Artificial Sequence
  Description of Artificial Sequence: Synthetic polypeptide
EVVLTQPPSLSASPGASARLTCKLNSGNIGSYYVHWYQQKPGSPPRTMIYRDDKRPDGVPSRFSGSKDSSSNSAFLLISGLQSEDEADYYCHSYDSTITPVFGGGTKLTVL

SEQ ID NO: 93 - protein, 112 aa, Artificial Sequence
  Description of Artificial Sequence: Synthetic polypeptide
DVQLTQSPSSLSASVGDRVTITCKLNSGNIGSYYVHWYQQKPGKAPKTMIYRDDKRPDGVPSRFSGSGDSSSNSAFLTISSLQPEDFATYYCHSYDSTITPVFGQGTKVEIK

SEQ ID NO: 94 - protein, 112 aa, Artificial Sequence
  Description of Artificial Sequence: Synthetic polypeptide
DVVLTQSPLSLPVTLGQPASISCRSSQSLLDSDGNTYLYWFQQRPGQSPRRLIYLVSNLGSGVPDRFSGSGSGTDFTLKISRVEAEDVGVYYCMQPTHAPYTFGQGTKLEIK

SEQ ID NO: 95 - protein, 112 aa, Artificial Sequence
  Description of Artificial Sequence: Synthetic polypeptide
DVQLTQSPSSLSASVGDRVTITCRSSQSLLDSDGNTYLYWFQQKPGKAPKRLIYLVSNLGSGVPSRFSGSGSGTDFTLTISSLQPEDFATYYCMQPTHAPYTFGQGTKVEIK

SEQ ID NO: 96 - protein, 112 aa, Artificial Sequence
  Description of Artificial Sequence: Synthetic polypeptide
DVLMTQTPLSLPVSLGDQASISCRSSQSIVDSDGITYLEWYLQKPGQSPKLLIYKVSNRFSGVPDRFSGSGSGTDFTLRISRVEAEDLGLYYCFQVSHVPWTFGGGTKLEIK

SEQ ID NO: 97 - protein, 112 aa, Artificial Sequence
  Description of Artificial Sequence: Synthetic polypeptide
DIVITQDELSNPVTSGESASISCRSSKSLLYKDGKTYLNWFLQRPGQSPQLLIYLMSTRASGVSDRFTGSGSGTDFTLEISRVKAEDVGVYYCQQPVEYPYTFGGGTKLEIK

SEQ ID NO: 98 - protein, 112 aa, Artificial Sequence
  Description of Artificial Sequence: Synthetic polypeptide
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPHTFGGGTKLEIK

SEQ ID NO: 99 - protein, 112 aa, Artificial Sequence
  Description of Artificial Sequence: Synthetic polypeptide
DVVMTQTPLTLSVTIGQAASISCKSSQSLLDSDGKTYLNWLLQRPGQSPKRLIYLVSKLDSGVPDRFTGSGSGTDFTLKISRVEAEDLGVYYCWQGTHFPHTFGGGTKLEIK

SEQ ID NO: 100 - protein, 107 aa, Artificial Sequence
  Description of Artificial Sequence: Synthetic polypeptide
DIQMTQTTSSLSASLGDRITISCRASQDISNYLNWYQRKPDGTVKLLIYYTSRLHSGVPSRFSGSGSGRDYSLTISNLEQEDIATYFCQQGNTLPYTFGGGTKLEIK

SEQ ID NO: 101 - protein, 106 aa, Artificial Sequence
  Description of Artificial Sequence: Synthetic polypeptide
DIQMTQSPSSLSASLGGKVTITCKASQDIHNYISWYQHKPGKGPRLVIHYTSTLQPGIPSRFSGSGSGRDYSFSISNLEPEDIATYYCLQYDNLYTFGGGTKLEIK

SEQ ID NO: 102-106 - skipped (5 entries)

SEQ ID NO: 107 - protein, 122 aa, Artificial Sequence
  Description of Artificial Sequence: Synthetic polypeptide
EVQLVQSGAEVKEPGASVKVSCKASGDTFNRYYVHWARQAPGQGLEWMGIINPSGVSTTYAQKFQGRVTMTRDTPTNTVYMELGSLRPEDTAVYFCAESRGSGYNYFAMDVWGQGTLVTVSS

SEQ ID NO: 108 - protein, 122 aa, Artificial Sequence
  Description of Artificial Sequence: Synthetic polypeptide
EVQLVQSGAEVKKPGASVKVSCKASGDTFKRYYVQWVRQAPGQGLEWMGIINPSGVSTTYAQKFQGRVTMTRDTSTSTVYMELSSLRSEDTAVYYCAESRGSGYNYFAMDVWGQGTLVTVSS

SEQ ID NO: 109 - protein, 122 aa, Artificial Sequence
  Description of Artificial Sequence: Synthetic polypeptide
EVQLVQSGAEVKKPGASVKVSCKASGYTFKRYYVHWVRQAPGQGLEWMGIINPSGVSTTYAQKFQGRVTMTRDTSTSTVYMELSSLRSEDTAVYYCAESRGSGYNYFAMDVWGQGTLVTVSS

SEQ ID NO: 110 - protein, 122 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAESRGSGYNYFAMDVWGQGTLVTVSS

SEQ ID NO: 111 - protein, 122 aa, Artificial Sequence
  Description of Artificial Sequence: Synthetic polypeptide
EVQLVQSGAEVKKPGASVKVSCKASGDTFNRYYVHWVRQAPGQGLEWMGIINPSGVSTTYAQKFQGRVTMTRDTSTSTVYMELSSLRSEDTAVYYCAESRIPGYNNFAMDVWGQGTLVTVSS

SEQ ID NO: 112 - protein, 122 aa, Artificial Sequence
  Description of Artificial Sequence: Synthetic polypeptide
EVQLVQSGAEVKKPGASVKVSCKASGDTFNRYYVHWVRQAPGQGLEWMGIINPSGVSTTYAQKFQGRVTMTRDTSTSTVYMELSSLRSEDTAVYYCAEVRGSGYNYFAMDVWGQGTLVTVSS

SEQ ID NO: 113 - protein, 122 aa, Artificial Sequence
  Description of Artificial Sequence: Synthetic polypeptide
EVQLVQSGAEVKKPGASVKVSCKASGDTFNRYYVHWVRQAPGQGLEWMGIINPSGVSTTYAQKFQGRVTMTRDTSTSTVYMELSSLRSEDTAVYYCAESRVPGYNNFAMDVWGQGTLVTVSS

SEQ ID NO: 114 - protein, 122 aa, Artificial Sequence
  Description of Artificial Sequence: Synthetic polypeptide
EVQLVQSGAEVKKPGASVKVSCKASGDTFNRYYVHWVRQAPGQGLEWMGIINPSGVSTTYAQKFQGRVTMTRDTSTSTVYMELSSLRSEDTAVYYCAEVRGSGYNYFGMDVWGQGTLVTVSS

SEQ ID NO: 115 - protein, 122 aa, Artificial Sequence
  Description of Artificial Sequence: Synthetic polypeptide
EVQLVQSGAEVKKPGASVKVSCKASGDTFNRYYVHWVRQAPGQGLEWMGIINPSGVSTTYAQKFQGRVTMTRDTSTSTVYMELSSLRSEDTAVYYCAESRGSGYNYFAMDVWGQGTLVTVSS

SEQ ID NO: 116 - protein, 122 aa, Artificial Sequence
  Description of Artificial Sequence: Synthetic polypeptide
EVQLVQSGAEVKKPGASVKVSCKASGDTFNRYYVQWVRQAPGQGLEWMGIINPSGVSTTYAQKFQGRVTMTRDTSTSTVYMELSSLRSEDTAVYYCAETRGSGYNYFGMDVWGQGTLVTVSS

SEQ ID NO: 117 - protein, 122 aa, Artificial Sequence
  Description of Artificial Sequence: Synthetic polypeptide
EVQLVQSGAEVKKPGASVKVSCKASGDTFKRYYMHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 118 - protein, 122 aa, Artificial Sequence
  Description of Artificial Sequence: Synthetic polypeptide
EVQLVQSGAEVKKPGASVKVSCKASGDTFHRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 119 - protein, 122 aa, Artificial Sequence
  Description of Artificial Sequence: Synthetic polypeptide
EVQLVQSGAEVKKPGASVKVSCKASGDTFNRYYVQWVRQAPGQGLEWMGIINPSGVSTTYAQKFQGRVTMTRDTSTSTVYMELSSLRSEDTAVYYCAETRGSGFNYFGMDVWGQGTLVTVSS

SEQ ID NO: 120 - protein, 122 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 121 - protein, 122 aa, Artificial Sequence
  Description of Artificial Sequence: Synthetic polypeptide
EVQLVQSGAEVKKPGASVKVSCKASGDTFNRYYVQWVRQAPGQGLEWMGIINPSGVSTTYAQKFQGRVTMTRDTSTSTVYMELSSLRSEDTAVYYCAESRVPGYNIFAMDVWGQGTLVTVSS

SEQ ID NO: 122 - protein, 122 aa, Artificial Sequence
  Description of Artificial Sequence: Synthetic polypeptide
EVQLVQSGAEVKKPGASVKVSCKASGDTFNRYYVHWVRQAPGQGLEWMGIINPSGVSTTYAQKFQGRVTMTRDTSTSTVYMELSSLRSEDTAVYYCAETRGSGYNYFGMDVWGQGTLVTVSS

SEQ ID NO: 123 - protein, 122 aa, Artificial Sequence
  Description of Artificial Sequence: Synthetic polypeptide
EVQLVQSGAEVKKPGASVKVSCKASGDTFKRYYAHWVRQAPGQGLEWMGIINPSGVSTTYAQKFQGRVTMTRDTSTSTVYMELSSLRSEDTAVYYCAESRLPGYNAFAMDVWGQGTLVTVSS

SEQ ID NO: 124 - protein, 122 aa, Artificial Sequence
  Description of Artificial Sequence: Synthetic polypeptide
EVQLVQSGAEVKKPGASVKVSCKASGDTFNRYYVQWVRQAPGQGLEWMGIINPSGVSTTYAQKFQGRVTMTRDTSTSTVYMELSSLRSEDTAVYYCAETRGPGFNYFGMDVWGQGTLVTVSS

SEQ ID NO: 125 - protein, 122 aa, Artificial Sequence
  Description of Artificial Sequence: Synthetic polypeptide
EVQLVQSGAGLVQPGGSVRVSCAASGFTFKRYYVHWVRQAPGKGLEWMGIINPSGVSTTYAQKFQGRVTISRDNSKNTLYMQLNSLRAEDTAVYYCARVRGSGFNYFGMDVWGQGTLVTVSS

SEQ ID NO: 126 - protein, 122 aa, Artificial Sequence
  Description of Artificial Sequence: Synthetic polypeptide
EVQLVESGAGLVKPGESVKVSCAASGFTFKRYYVHWVRQAPGKGLEWMGIINPSGVSTTYAQKFQGRVTISRDNSTNTLYMELNSLRAEDTAVYYCARVRGSGFNYFGMDVWGQGTLVTVSS

SEQ ID NO: 127 - protein, 122 aa, Artificial Sequence
  Description of Artificial Sequence: Synthetic polypeptide
EVQLVESGAGVVKPGESVKVSCAASGFTFKRYYVHWVRQAPGKGLEWMGIINPSGVSTTYAQKFQGRVTMSRDTSTSTVYMELNSLRAEDTAVYYCARVRGSGFNYFGMDVWGQGTLVTVSS

SEQ ID NO: 128 - protein, 122 aa, Artificial Sequence
  Description of Artificial Sequence: Synthetic polypeptide
EVQLVESGGGLVQPGGSLRLSCAASGFTFKRYYVHWVRQAPGKGLEWVGIINPSGVSTTYAQKFQGRFTISRDNSKNTLYLQMNSLRAEDTAVYYCARVRGSGFNYFGMDVWGQGTLVTVSS

SEQ ID NO: 129 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSS

SEQ ID NO: 130-135 - skipped (6 entries)

SEQ ID NO: 136 - protein, 106 aa, Artificial Sequence
  Description of Artificial Sequence: Synthetic polypeptide
SYELTQPPSVSVSPGQTADITCSGDKLGDKYASWYQQKPGQSPVLVIYQDNRRPSGIPERFSGSNSGNTATLTISGTQAMDEADYYCQAWDSDTYVFGPGTKVTVL

SEQ ID NO: 137 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVL

SEQ ID NO: 138 - protein, 106 aa, Artificial Sequence
  Description of Artificial Sequence: Synthetic polypeptide
SYELTQPPSVSVSPGQTASITCSGDNLGYKYVSWYQQKPGQSPVLVIYQDHRRPSGIPERFSGSNSGNTATLTISGTQAMDEADYYCQAWDTDTYVFGTGTKVTVL

SEQ ID NO: 139 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDNRRPSGIPERFSGSNSGNTATLTISGTQAMDEADYYCQVWDSDTYVFGTGTKVTVL

SEQ ID NO: 140 - protein, 106 aa, Artificial Sequence
  Description of Artificial Sequence: Synthetic polypeptide
SYELTQPPSVSVSPGQTASITCSGDMLGYQYGSWYQQKPGQSPVLVIYQDNRRPSGIPERFSGSNSGNTATLTISGTQAMDEADYYCQAWDGDAFVFGTGTKVTVL

SEQ ID NO: 141 - protein, 106 aa, Artificial Sequence
  Description of Artificial Sequence: Synthetic polypeptide
SYELTQPPSVSVAPGQTARISCSGDKLGDKYASWYQQKPGQAPVLVIYQDNRRPSGIPERFSGSNSGNTATLTISGTQAEDEADYYCQAWDSDTYVFGGGTKLTVL

SEQ ID NO: 142 - protein, 107 aa, Artificial Sequence
  Description of Artificial Sequence: Synthetic polypeptide
DIQMTQSPSSLSASVGDRVTITCSGDKLGDKYASWYQQKPGKAPKLLIYQDNRRPSGVPSRFSGSGSGTDFTLTISSLQPEDFATYYCQAWDSDTYVFGQGTKVEIK

SEQ ID NO: 143 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYITPLTFGGGTKVEIK

SEQ ID NO: 144-150 - skipped (7 entries)

SEQ ID NO: 151 - protein, 116 aa, Artificial Sequence
  Description of Artificial Sequence: Synthetic polypeptide
QVQLQQSGPELVKPGASVRISCKASGYTFTTYYIHWVKQRPGQGLEWIGWIYPGNVNTNYNEKFKGKATLTADKSSSTAYMQLTSLTSEDSAVYFCARGVYYFDYWGQGTILTVSS

SEQ ID NO: 152-160 - skipped (9 entries)

SEQ ID NO: 161 - protein, 107 aa, Artificial Sequence
  Description of Artificial Sequence: Synthetic polypeptide
SIVMTQTPKFLLVSAGDRVTITCKASQSVNNDVSWFQQKPGQSPTLLIYYASNRYTGVPDRFTGSGYGTDFTFTISTVQAEDLAVYFCQQDYSSPYTFGGGTKLEIK

SEQ ID NO: 162-170 - skipped (9 entries)

SEQ ID NO: 171 - protein, 119 aa, Artificial Sequence
  Description of Artificial Sequence: Synthetic polypeptide
EVQLVESGGGLVQPGGSLRLSCAASGFSLTNYGVHWVRQAPGKGLEWLGVIWSGGNTDYNTPFTSRLTINKDNSKNTVYLQMNSLRAEDTAVYYCARALTYYDYEFAYWGQGTLVTVSS

SEQ ID NO: 172-180 - skipped (9 entries)

SEQ ID NO: 181 - protein, 107 aa, Artificial Sequence
  Description of Artificial Sequence: Synthetic polypeptide
DILLTQSPGTLSLSPGERATLSCRASQSIYTNIHWYQQKPGQAPRLLIKYASESISGIPDRFSGSGSGTDFTLTISRLEPEDFAVYYCQQNNNWPTTFGQGTKLEIK

SEQ ID NO: 182-190 - skipped (9 entries)

SEQ ID NO: 191 - protein, 122 aa, Artificial Sequence
  Description of Artificial Sequence: Synthetic polypeptide
DVQLQESGPGLVKPSQSLSLTCSVTGYSITSGYYWNWIRQFPGSKLEWMGYISYDGNNNYNPSLKNRISITRDTSKNQFFLKLNSVTTEDTATYYCARERYYDYDGYAVDYWGQGTSVTVSS

SEQ ID NO: 192 - protein, 120 aa, Artificial Sequence
  Description of Artificial Sequence: Synthetic polypeptide
EVKLVESEGGLVQPGSSMKLSCTASGFTFSDYYMAWVRQVPEKGLEWVANINYDGTTTYYLDSLKSRFIISRDNSKNILYLQMSSLKSEDTATYYCARVLDGYYGYFDYWGQGTTLSVSS

SEQ ID NO: 193 - protein, 120 aa, Artificial Sequence
  Description of Artificial Sequence: Synthetic polypeptide
DVKLVESGEGLVKPGGSLKLSCAASGFTFSSYAMSWVRQTPEKRLEWVAYISSGGDYIYYADTMKGRFTISRDNARNTLYLQMSSLKSEDTAMYYCTRVFDGYYARFLYWGQGTLVTVSA

SEQ ID NO: 194 - protein, 126 aa, Artificial Sequence
  Description of Artificial Sequence: Synthetic polypeptide
QVTLKESGPGILQSSQTLSLTCSFSGFSLSTSGMGVSWIRQPSGKGLEWLAHIYWDDDQRYNPSLKSRLTISKDASGNQVFLKITSVDTADTATYYCTRRGGYGSSKGYYYVMDYWGQGTSVTVSS

SEQ ID NO: 195 - protein, 120 aa, Artificial Sequence
  Description of Artificial Sequence: Synthetic polypeptide
QVQLQQPGAELVKPGASVKVSCKASGYTFTNYWMHWVKQRPGQGLEWIGRIHPSDSDTNYNQRFKGKATLTVDKSSTTAYMQLSSLTSEDSAVYYCAIEDYSNYVDFDVWGTGTTVTVSS

SEQ ID NO: 196 - protein, 120 aa, Artificial Sequence
  Description of Artificial Sequence: Synthetic polypeptide
QIQLVQSGPELKKPGETVKISCKASGYTFTTYGVSWVKQAPGKGLKWMGWINTYSGVPTYADDFKGRFAFSLETSASTAYLQITNLKNEDTATYFCARQEAFYNRTMDYWGQGTSVTVSS

SEQ ID NO: 197 - protein, 118 aa, Artificial Sequence
  Description of Artificial Sequence: Synthetic polypeptide
EVQLQQSGPVLVKPGASVKMSCKASGYTFTDYYMNWVKQSHGKSLEWIGLINPNSGGINYNQKFKVKATLTVDKSSSTAYMELNSLTSEDSAVYYCARRDYGTSGDYWGQGTSVTVSS

SEQ ID NO: 198-200 - skipped (3 entries)

SEQ ID NO: 201 - protein, 107 aa, Artificial Sequence
  Description of Artificial Sequence: Synthetic polypeptide
DIQMTQSPASLSVSVGETVTITCRASENIYSNLAWYQQKQGKSPQLLVYGATNLADGVTSRFSGSGSGTQYSLKINSLQSEDFGSYYCQNFWGTTWTFGGGTKLEIK

SEQ ID NO: 202 - protein, 106 aa, Artificial Sequence
  Description of Artificial Sequence: Synthetic polypeptide
QIVLTQSPAIMSASPGEKVTISCSASSSVSYMYWYQQKPGSSPKPWIYRTYNLASGVPARFSGSGSGTSYSLTISSMEAEDAATYYCQQSHTYPPTFGGGTKLEIK

SEQ ID NO: 203 - protein, 107 aa, Artificial Sequence
  Description of Artificial Sequence: Synthetic polypeptide
DIVMTQSQKFMSTSVGDRVSVTCKASQNVDTNVAWYQQKPGQSPKALIYSTSYRYSGVPDRFTGSGSGTDFTLTINNVQSEDLAEYFCQQYNNYPLTFGTGTKLELK

SEQ ID NO: 204 - protein, 107 aa, Artificial Sequence
  Description of Artificial Sequence: Synthetic polypeptide
DIQMTQSPSSLSASLGERVSLTCRASQDIGTRLNWLQQEPDGTIKRLIYATSSLDSGVPKRFSGSRSGSVYSLTISSLESEDFVDYYCVQYASSPYTFGGGTKLEIK

SEQ ID NO: 205 - protein, 111 aa, Artificial Sequence
  Description of Artificial Sequence: Synthetic polypeptide
DILLTQSPASLAVSLGQRATISCRASESVDTYGITFIHWYQQKPGQPPKLLIYRASNLESGIPARFSGSGSKTDFTLTINPVETDDVATYYCQQNNKDPRTFGGGTKLEIR

SEQ ID NO: 206 - protein, 108 aa, Artificial Sequence
  Description of Artificial Sequence: Synthetic polypeptide
ENVLTQSPAIMSASPGEKVTMTCRASSSVSSSYLHWYQQKSGASPKLWIYSRSTLASGVPARFSGSGSGTSYSLTISSVEAEDAATYYCQQYRGYPLTFGSGTKLEIK

SEQ ID NO: 207 - protein, 107 aa, Artificial Sequence
  Description of Artificial Sequence: Synthetic polypeptide
DIQMNQSPSSLSASLGDTITITCHASQNINVWLSWYQQKPGNIPKLLIYKASNLHTGVPSRFSGSGSGTGFTLTISSLQPEDIATYYCQQGQSYPLTFGAGTKLELK

SEQ ID NO: 208-210 - skipped (3 entries)

SEQ ID NO: 211 - protein, 114 aa, Artificial Sequence
  Description of Artificial Sequence: Synthetic polypeptide
QVQLRQPGAELVKPGASVKLSCKTSGYTFTSYWMHWVKQRPGQGLEWIGEIDPSDSYINYNQKFKGEATLTVDKSSSTAYMQLSSLTSEDSAVYYCARGPRDYWGQGTTLTVSS

SEQ ID NO: 212 - protein, 123 aa, Artificial Sequence
  Description of Artificial Sequence: Synthetic polypeptide
QVQLQQSGAELARPGASVKLSCKASGYTFTTYWMQWVKQRPGQGLEWIGAIYPGDGDTRYTQKFKGKATLTADKSSSTAYMQLSSLASEDSAVYYCARGRDYSGSSWTWFAYWGQGTLVTVSA

SEQ ID NO: 213 - protein, 114 aa, Artificial Sequence
  Description of Artificial Sequence: Synthetic polypeptide
EVQLVQSGAEVKKPGSSVKVSCKTSGYTFTSYWMHWVRQAPGQGLEWIGEIDPSDSYINYNQKFKGRATLTVDKSTSTAYMELSSLRSEDTAVYYCARGPRDYWGQGTTVTVSS

SEQ ID NO: 214 - protein, 123 aa, Artificial Sequence
  Description of Artificial Sequence: Synthetic polypeptide
EVQLVQSGAEVKKPGSSVKVSCKASGYTFTTYWMQWVRQAPGQGLEWMGAIYPGDGDTRYTQKFKGRVTLTADKSTSTAYMELSSLRSEDTAVYYCARGRDYSGSSWTWFAYWGQGTLVTVSS

SEQ ID NO: 215 - protein, 114 aa, Artificial Sequence
  Description of Artificial Sequence: Synthetic polypeptide
EVQLVQSGAEVKKPGSSVKVSCKASGYTFTSYWMHWVRQAPGQGLEWMGEIDPSDSYINYNQKFKGRVTLTVDKSTSTAYMELSSLRSEDTAVYYCARGPRDYWGQGTTVTVSS

SEQ ID NO: 216 - protein, 120 aa, Artificial Sequence
  Description of Artificial Sequence: Synthetic polypeptide
EVKLVESGGGLVQPGGSVRLSCATSGFTFSDYYMSWVRQPPGKALELLGFIRNKANGYTREYSASVKGRFTMSRDNSQSVLYLQMNTLRAEDSATYYCARDSHRTYFDYWGQGTTLTVSS

SEQ ID NO: 217 - protein, 120 aa, Artificial Sequence
  Description of Artificial Sequence: Synthetic polypeptide
EVQLVESGGGLVQPGGSLRLSCATSGFTFSDYYMSWVRQAPGKGLELLGFIRNKANGYTREYSASVKGRFTMSRDNSKNSLYLQMNSLKTEDTAVYYCARDSHRTYFDYWGQGTTVTVSS

SEQ ID NO: 218 - protein, 118 aa, Artificial Sequence
  Description of Artificial Sequence: Synthetic polypeptide
DVQLQESGPGLVKPAQSLSLTCSVTGYSITSGYYWNWNRQFPGIKLEWMGYITYEGTNNYNPSLKNRISITRDTSKNQFFLKLNSVTTEDTATYYCAREALWRAMDYWGQGTSVTVSS

SEQ ID NO: 219 - protein, 118 aa, Artificial Sequence
  Description of Artificial Sequence: Synthetic polypeptide
EVQLQESGPGLVKPSGTLSLTCAVTGYSITSGYYWNWNRQFPGKGLEWMGYITYEGTNNYNPSLKNRISISRDKSKNQFSLKLSSVTAADTAVYYCAREALWRAMDYWGQGTTVTVSS

SEQ ID NO: 220 - skipped

SEQ ID NO: 221 - protein, 107 aa, Artificial Sequence
  Description of Artificial Sequence: Synthetic polypeptide
DIQMTQTTSSLSASLGDRVTISCSASQGISNYLNWYQQKPDGTVKLLIYYTSRLHSGVPSRFSGSGSGTDFSLTISNLEPEDIATYYCQQYSKLPYTFGGGTKLEVK

SEQ ID NO: 222 - protein, 112 aa, Artificial Sequence
  Description of Artificial Sequence: Synthetic polypeptide
DIVMSQSPSSLAVSAGEKVTMSCKSSQSLLNSRTRKSYLAWYQQKPGQSPKVLIYWASSRESGVPDRFTGSGSGTDFTLTISSVQPEDLAVYYCKQSYNLYTFGGGTKLEIK

SEQ ID NO: 223 - protein, 107 aa, Artificial Sequence
  Description of Artificial Sequence: Synthetic polypeptide
DIQMTQSPSSLSASVGDRVTITCSASQGISNYLNWYQQKPGKAVKLLIYYTSRLHSGVPSRFSGSGSGTDFTLTISSLQPEDFATYYCQQYSKLPYTFGGGTKVEIK

SEQ ID NO: 224 - protein, 112 aa, Artificial Sequence
  Description of Artificial Sequence: Synthetic polypeptide
DIVMTQSPDSLAVSLGERATINCKSSQSLLNSRTRKSYLAWYQQKPGQPPKVLIYWASSRESGVPDRFSGSGSGTDFTLTISSLQAEDVAVYYCKQSYNLYTFGGGTKVEIK

SEQ ID NO: 225 - protein, 108 aa, Artificial Sequence
  Description of Artificial Sequence: Synthetic polypeptide
QIVLSQSPAILSASPGEKVTMTCRASSSVSSMHWYQQKPGSSPKPWIYATSNLASGVPTRFSGSGSGTSYSLTISRVEAEDAATYYCQQWSSNPPMYTFGGGTKLEIK

SEQ ID NO: 226 - protein, 108 aa, Artificial Sequence
  Description of Artificial Sequence: Synthetic polypeptide
EIVLTQSPDFQSVTPKEKVTITCRASSSVSSMHWYQQKPDQSPKPWIYATSNLASGVPSRFSGSGSGTDYTLTINSLEAEDAATYYCQQWSSNPPMYTFGGGTKVEIK

SEQ ID NO: 227 - protein, 108 aa, Artificial Sequence
  Description of Artificial Sequence: Synthetic polypeptide
DIQLTQSPSFLSASVGDRVTITCRASSSVSSMHWYQQKPGKSPKPWIYATSNLASGVPSRFSGSGSGTEYTLTISSLQPEDFATYYCQQWSSNPPMYTFGGGTKVEIK

SEQ ID NO: 228 - protein, 106 aa, Artificial Sequence
  Description of Artificial Sequence: Synthetic polypeptide
ENVLTQSPAIMSASPGEKVTMTCSASSSVSYMHWYQQKSGTSPKLWIYDTSKLASGVPGRFSGSGSGNSYSLTISSMEAEDVATYYCFQGSGYPLTFGAGTKLELK

SEQ ID NO: 229 - protein, 106 aa, Artificial Sequence
  Description of Artificial Sequence: Synthetic polypeptide
DNQLTQSPSFLSASVGDRVTITCSASSSVSYMHWYQQKPGKSPKLWIYDTSKLASGVPSRFSGSGSGTEYSLTISSLQPEDFATYYCFQGSGYPLTFGQGTKLEIK

SEQ ID NO: 230 - protein, 106 aa, Artificial Sequence
  Description of Artificial Sequence: Synthetic polypeptide
DNQLTQSPSFLSASVGDRVTITCSASSSVSYMHWYQQKPGKAPKLWIYDTSKLASGVPSRFSGSGSGTEYTLTISSLQPEDFATYYCFQGSGYPLTFGQGTKLEIK

SEQ ID NO: 231-240 - skipped (10 entries)

SEQ ID NO: 241 - protein, 10 aa, Artificial Sequence
  Description of Artificial Sequence: Synthetic peptide
GDTFKRYYVH

SEQ ID NO: 242 - protein, 17 aa, Artificial Sequence
  Description of Artificial Sequence: Synthetic peptide
IINPSGVSTTYAQKFQG

SEQ ID NO: 243 - protein, 13 aa, Artificial Sequence
  Description of Artificial Sequence: Synthetic peptide
VRGSGFNYFGMDV

SEQ ID NO: 244 - protein, 11 aa, Artificial Sequence
  Description of Artificial Sequence: Synthetic peptide
SGDKLGDKYAS

SEQ ID NO: 245 - protein, 7 aa, Artificial Sequence
  Description of Artificial Sequence: Synthetic peptide
QDNRRPS

SEQ ID NO: 246 - protein, 9 aa, Artificial Sequence
  Description of Artificial Sequence: Synthetic peptide
QAWDSDTYV

SEQ ID NO: 247-250 - skipped (4 entries)

SEQ ID NO: 251 - protein, 18 aa, Artificial Sequence
  Description of Artificial Sequence: Synthetic peptide
VDGASSPVNVSSPSVQDI

SEQ ID NO: 252 - skipped

SEQ ID NO: 253 - protein, 18 aa, Artificial Sequence
  Description of Artificial Sequence: Synthetic peptide
VDGASSPVNVGSPSVQDI

SEQ ID NO: 254 - protein, 13 aa, Artificial Sequence
  Description of Artificial Sequence: Synthetic peptide
GASSPVNVSSPSV

SEQ ID NO: 255 - protein, 18 aa, Artificial Sequence
  Description of Artificial Sequence: Synthetic peptide
GGGGSGGGNGTGSGGGGS

SEQ ID NO: 256 - protein, 18 aa, Artificial Sequence
  Description of Artificial Sequence: Synthetic peptide
LSAGGHGGLDNDTSAFHL

SEQ ID NO: 257 - protein, 18 aa, Artificial Sequence
  Description of Artificial Sequence: Synthetic peptide
SDKTHTSPPSPAPESSGG

SEQ ID NO: 258 - protein, 18 aa, Artificial Sequence
  Description of Artificial Sequence: Synthetic peptide
VTTTDFQIQTEMAATMET

SEQ ID NO: 259 - protein, 18 aa, Artificial Sequence
  Description of Artificial Sequence: Synthetic peptide
DFLPTTAQPTKKSTLKKR

SEQ ID NO: 260 - protein, 18 aa, Artificial Sequence
  Description of Artificial Sequence: Synthetic peptide
TESRSPPAENEVSTPMQA

SEQ ID NO: 261 - protein, 18 aa, Artificial Sequence
  Description of Artificial Sequence: Synthetic peptide
GGGGSGGGNGSGSGGGGS

SEQ ID NO: 262 - protein, 18 aa, Artificial Sequence
  Description of Artificial Sequence: Synthetic peptide
GGGGSGGGSGGGSGGGGS

SEQ ID NO: 263-270 - skipped (8 entries)

SEQ ID NO: 271 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 272 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 273 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 274 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 275-279 - skipped (5 entries)

SEQ ID NO: 280 - protein, 10 aa, Artificial Sequence
  Description of Artificial Sequence: Synthetic peptide
GYTFTSYYIY

SEQ ID NO: 281 - protein, 17 aa, Artificial Sequence
  Description of Artificial Sequence: Synthetic peptide
NIWPGNGGTFYGEKFMG

SEQ ID NO: 282 - protein, 12 aa, Artificial Sequence
  Description of Artificial Sequence: Synthetic peptide
RPDYSGDDYFDY

SEQ ID NO: 283 - protein, 13 aa, Artificial Sequence
  Description of Artificial Sequence: Synthetic peptide
KLNSGNIGSYYVH

SEQ ID NO: 284 - protein, 7 aa, Artificial Sequence
  Description of Artificial Sequence: Synthetic peptide
RDDKRPD

SEQ ID NO: 285 - protein, 10 aa, Artificial Sequence
  Description of Artificial Sequence: Synthetic peptide
HSYDSTITPV

SEQ ID NO: 286-300 - skipped (15 entries)

SEQ ID NO: 301 - protein, 15 aa, Artificial Sequence
  Description of Artificial Sequence: Synthetic peptide
GGGGSGGGGSGGGGS

SEQ ID NO: 302 - protein, 20 aa, Artificial Sequence
  Description of Artificial Sequence: Synthetic peptide
GGGGSGGGGSGGGGSGGGGS

SEQ ID NO: 303 - protein, 25 aa, Artificial Sequence
  Description of Artificial Sequence: Synthetic peptide
GGGGSGGGGSGGGGSGGGGSGGGGS

SEQ ID NO: 304 - protein, 30 aa, Artificial Sequence
  Description of Artificial Sequence: Synthetic polypeptide
GGGGSGGGGSGGGGSGGGGSGGGGSGGGGS

SEQ ID NO: 305 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 306 - protein, 40 aa, Artificial Sequence
  Description of Artificial Sequence: Synthetic polypeptide
GGGGSGGGGSGGGGSGGGGSGGGGSGGGGSGGGGSGGGGS

SEQ ID NO: 307-309 - skipped (3 entries)

SEQ ID NO: 310 - protein, 442 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 441 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 312 - protein, 442 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 313 - protein, 441 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 314 - protein, 442 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEYKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 315 - protein, 441 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEYKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 316-319 - skipped (4 entries)

SEQ ID NO: 320 - protein, 219 aa, Artificial Sequence
  Description of Artificial Sequence: Synthetic polypeptide
DAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 321 - protein, 219 aa, Artificial Sequence
  Description of Artificial Sequence: Synthetic polypeptide
DIVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 322 - protein, 219 aa, Artificial Sequence
  Description of Artificial Sequence: Synthetic polypeptide
DVVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 323-329 - skipped (7 entries)

SEQ ID NO: 330 - protein, 451 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 331 - protein, 450 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 332 - protein, 448 aa, Artificial Sequence
  Description of Artificial Sequence: Synthetic polypeptide
EVQLVQSGAEVKKPGSSVKVSCKASDYTFNDYWVSWVRQAPGQGLEWIGEIYPNSGATNFNGKFRGRATLTVDNSASTAYMELSSLRSEDTAVYYCTREYTRDWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 333 - protein, 447 aa, Artificial Sequence
  Description of Artificial Sequence: Synthetic polypeptide
EVQLVQSGAEVKKPGSSVKVSCKASDYTFNDYWVSWVRQAPGQGLEWIGEIYPNSGATNFNGKFRGRATLTVDNSASTAYMELSSLRSEDTAVYYCTREYTRDWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 334 - protein, 217 aa, Artificial Sequence
  Description of Artificial Sequence: Synthetic polypeptide
NVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 335 - protein, 219 aa, Artificial Sequence
  Description of Artificial Sequence: Synthetic polypeptide
DVVLTQSPLSLPVTLGQPASISCRSSQSLLDSDGNTYLYWFQQRPGQSPRRLIYLVSNLGSGVPDRFSGSGSGTDFTLKISRVEAEDVGVYYCMQPTHAPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 336-341 - skipped (6 entries)

SEQ ID NO: 342 - protein, 13 aa, Artificial Sequence
  Description of Artificial Sequence: Synthetic peptide
ASTKGPSVFPLAP

SEQ ID NO: 343 - protein, 6 aa, Artificial Sequence
  Description of Artificial Sequence: Synthetic peptide
ASTKGP

SEQ ID NO: 344 - protein, 12 aa, Artificial Sequence
  Description of Artificial Sequence: Synthetic peptide
TVAAPSVFIFPP

SEQ ID NO: 345 - protein, 5 aa, Artificial Sequence
  Description of Artificial Sequence: Synthetic peptide
TVAAP

SEQ ID NO: 346 - protein, 10 aa, Artificial Sequence
  Description of Artificial Sequence: Synthetic peptide
GGGGSGGGGS

SEQ ID NO: 347 - protein, 9 aa, Artificial Sequence
  Description of Artificial Sequence: Synthetic peptide
GGSGGGGSG

SEQ ID NO: 348-350 - skipped (3 entries)

SEQ ID NO: 351 - protein, 720 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSDAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKR

SEQ ID NO: 352 - protein, 720 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSDAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKR

SEQ ID NO: 353 - protein, 720 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSQVQLQESGPGLVKPSETLSLTCTVSGYSITSNYYWNWIRQPPGKGLEWMGYIRYDGSNNYNPSLKNRITISRDTSKNQFSLKLSSVTAADTAVYYCARLDYWGQGTLVTVSSGGGGSGGGGSGGGGSGGGGSGGGGSDAVMTQSPLSLPVTLGEPASISCRSSQSLENTNGNTFLNWFQQKPGQSPRLLIYRVSNRFSGVPDRFSGSGSGTDFTLKISRVEAEDVGVYYCLQVTHVPFTFGQGTKLEIKR

SEQ ID NO: 354 - protein, 720 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSQVQLQESGPGLVKPSETLSLTCTVSGYSITSNYYWNWIRQPPGKGLEWMGYIRYDGSNNYNPSLKNRITISRDTSKNQFSLKLSSVTAADTAVYYCARLDYWGQGTLVTVSSGGGGSGGGGSGGGGSGGGGSGGGGSDAVMTQSPLSLPVTLGEPASISCRSSQSLENTNGNTFLNWFQQKPGQSPRLLIYRVSNRFSGVPDRFSGSGSGTDFTLKISRVEAEDVGVYYCLQVTHVPFTFGQGTKLEIKR

SEQ ID NO: 355 - protein, 720 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSQVQLQESGPGLVKPSETLSLTCTVSGYSITSNYYWNWIRQPPGKGLEWMGYIRYDGSNNYNPSLKNRITISRDTSKNQFSLKLSSVTAADTAVYYCARLDYWGQGTLVTVSSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKR

SEQ ID NO: 356 - protein, 720 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSQVQLQESGPGLVKPSETLSLTCTVSGYSITSNYYWNWIRQPPGKGLEWMGYIRYDGSNNYNPSLKNRITISRDTSKNQFSLKLSSVTAADTAVYYCARLDYWGQGTLVTVSSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKR

SEQ ID NO: 357 - protein, 720 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLVESGGGLVQPGGSLRLSCAASGYSITSNYYWNWVRQAPGKGLEWMGYIRYDGSNNYNPSLKNRITISRDTSKNTFYLQMNSLRAEDTAVYYCARLDYWGQGTLVTVSSGGGGSGGGGSGGGGSGGGGSGGGGSDAVMTQSPLSLPVTLGEPASISCRSSQSLENTNGNTFLNWFQQKPGQSPRLLIYRVSNRFSGVPDRFSGSGSGTDFTLKISRVEAEDVGVYYCLQVTHVPFTFGQGTKLEIKR

SEQ ID NO: 358 - protein, 720 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLVESGGGLVQPGGSLRLSCAASGYSITSNYYWNWVRQAPGKGLEWMGYIRYDGSNNYNPSLKNRITISRDTSKNTFYLQMNSLRAEDTAVYYCARLDYWGQGTLVTVSSGGGGSGGGGSGGGGSGGGGSGGGGSDAVMTQSPLSLPVTLGEPASISCRSSQSLENTNGNTFLNWFQQKPGQSPRLLIYRVSNRFSGVPDRFSGSGSGTDFTLKISRVEAEDVGVYYCLQVTHVPFTFGQGTKLEIKR

SEQ ID NO: 359 - protein, 720 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLVESGGGLVQPGGSLRLSCAASGYSITSNYYWNWVRQAPGKGLEWMGYIRYDGSNNYNPSLKNRITISRDTSKNTFYLQMNSLRAEDTAVYYCARLDYWGQGTLVTVSSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKR

SEQ ID NO: 360 - protein, 720 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLVESGGGLVQPGGSLRLSCAASGYSITSNYYWNWVRQAPGKGLEWMGYIRYDGSNNYNPSLKNRITISRDTSKNTFYLQMNSLRAEDTAVYYCARLDYWGQGTLVTVSSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKR

SEQ ID NO: 361 - protein, 719 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSDAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKR

SEQ ID NO: 362 - protein, 719 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSDAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKR

SEQ ID NO: 363 - protein, 719 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSQVQLQESGPGLVKPSETLSLTCTVSGYSITSNYYWNWIRQPPGKGLEWMGYIRYDGSNNYNPSLKNRITISRDTSKNQFSLKLSSVTAADTAVYYCARLDYWGQGTLVTVSSGGGGSGGGGSGGGGSGGGGSGGGGSDAVMTQSPLSLPVTLGEPASISCRSSQSLENTNGNTFLNWFQQKPGQSPRLLIYRVSNRFSGVPDRFSGSGSGTDFTLKISRVEAEDVGVYYCLQVTHVPFTFGQGTKLEIKR

SEQ ID NO: 364 - protein, 719 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSQVQLQESGPGLVKPSETLSLTCTVSGYSITSNYYWNWIRQPPGKGLEWMGYIRYDGSNNYNPSLKNRITISRDTSKNQFSLKLSSVTAADTAVYYCARLDYWGQGTLVTVSSGGGGSGGGGSGGGGSGGGGSGGGGSDAVMTQSPLSLPVTLGEPASISCRSSQSLENTNGNTFLNWFQQKPGQSPRLLIYRVSNRFSGVPDRFSGSGSGTDFTLKISRVEAEDVGVYYCLQVTHVPFTFGQGTKLEIKR

SEQ ID NO: 365 - protein, 719 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSQVQLQESGPGLVKPSETLSLTCTVSGYSITSNYYWNWIRQPPGKGLEWMGYIRYDGSNNYNPSLKNRITISRDTSKNQFSLKLSSVTAADTAVYYCARLDYWGQGTLVTVSSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKR

SEQ ID NO: 366 - protein, 719 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSQVQLQESGPGLVKPSETLSLTCTVSGYSITSNYYWNWIRQPPGKGLEWMGYIRYDGSNNYNPSLKNRITISRDTSKNQFSLKLSSVTAADTAVYYCARLDYWGQGTLVTVSSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKR

SEQ ID NO: 367 - protein, 719 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLVESGGGLVQPGGSLRLSCAASGYSITSNYYWNWVRQAPGKGLEWMGYIRYDGSNNYNPSLKNRITISRDTSKNTFYLQMNSLRAEDTAVYYCARLDYWGQGTLVTVSSGGGGSGGGGSGGGGSGGGGSGGGGSDAVMTQSPLSLPVTLGEPASISCRSSQSLENTNGNTFLNWFQQKPGQSPRLLIYRVSNRFSGVPDRFSGSGSGTDFTLKISRVEAEDVGVYYCLQVTHVPFTFGQGTKLEIKR

SEQ ID NO: 368 - protein, 719 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLVESGGGLVQPGGSLRLSCAASGYSITSNYYWNWVRQAPGKGLEWMGYIRYDGSNNYNPSLKNRITISRDTSKNTFYLQMNSLRAEDTAVYYCARLDYWGQGTLVTVSSGGGGSGGGGSGGGGSGGGGSGGGGSDAVMTQSPLSLPVTLGEPASISCRSSQSLENTNGNTFLNWFQQKPGQSPRLLIYRVSNRFSGVPDRFSGSGSGTDFTLKISRVEAEDVGVYYCLQVTHVPFTFGQGTKLEIKR

SEQ ID NO: 369 - protein, 719 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLVESGGGLVQPGGSLRLSCAASGYSITSNYYWNWVRQAPGKGLEWMGYIRYDGSNNYNPSLKNRITISRDTSKNTFYLQMNSLRAEDTAVYYCARLDYWGQGTLVTVSSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKR

SEQ ID NO: 370 - protein, 719 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLVESGGGLVQPGGSLRLSCAASGYSITSNYYWNWVRQAPGKGLEWMGYIRYDGSNNYNPSLKNRITISRDTSKNTFYLQMNSLRAEDTAVYYCARLDYWGQGTLVTVSSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKR

SEQ ID NO: 371 - protein, 212 aa, Artificial Sequence
  Description of Artificial Sequence: Synthetic polypeptide
SYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 372 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYITPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 373-399 - skipped (27 entries)

SEQ ID NO: 400 - protein, 750 aa, Artificial Sequence
  Description of Artificial Sequence: Synthetic polypeptide
EVQLVESGGGLVQPGRSLKLSCAASGFTFSNYDMAWVRQAPTKGLEWVASISPSGGRTYYRDSVKGRFTVSRDNAKSTLYLQMDSLRSEDTATYYCARHDGSYFDYWGQGVMVTVSSDLSGGGGSGGGGSGGGGSGGGGSTGDTVLTQSPALAVSPGERVTISCRASESVSTLMHWYQQKPGQQPKLLIYLASHLESGVPARFSGSGSGTDFTLTIDPVEADDTATYYCQESWNDPWTFGGGTKLELKRLEVPRDSGSKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKVDGASSPVNVSSPSVQDIQVQLVQSGAEVKKPGASVKVSCKASGYTFTGNYINWVRQAPGQGLEWMGIINPTKGWTLYAQKFQGRVTMTRDTSISTAYMELSSLRSEDTAVYYCARWHHGTWIFDYWGQGTLVTVSSDLSGGGGSGGGGSGGGGSGGGGSTGDIVLTQPPSVSGAPGQRVTISCSGSSSNIGSNYVSWYQQLPGTAPKLLIYNDNQRPSGVPDRFSGSKSGTSASLAITGLQSEDEADYYCSTYDRRTFSVFGGGTKLTVLG

SEQ ID NO: 401 - protein, 763 aa, Artificial Sequence
  Description of Artificial Sequence: Synthetic polypeptide
EVQLVQSGAEVKEPGASVKVSCKASGDTFNRYYVHWARQAPGQGLEWMGIINPSGVSTTYAQKFQGRVTMTRDTPTNTVYMELGSLRPEDTAVYFCAESRGSGYNYFAMDVWGQGTLVTVSSDLSGGGGSGGGGSGGGGSGGGGSTGSYELTQPPSVSVSPGQTADITCSGDKLGDKYASWYQQKPGQSPVLVIYQDNRRPSGIPERFSGSNSGNTATLTISGTQAMDEADYYCQAWDSDTYVFGPGTKVTVLGLEEPKSSDKTHTCPPCPAPELLGGPSVFLFPPKPKDTLMISRTPEVTCVVVDVSHEDPEYKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIEVQLVQSGAEVKKPGSSVKVSCKASGYTFTSYWMHWVRQAPGQGLEWIGNIDPSNGETHYNQKFKDRATLTVDKSTSTAYMELSSLRSEDTAVYYCARERIYYSGSTYDGYFDVWGQGTTVTVSSDLSGGGGSGGGGSGGGGSGGGGSTGDIQLTQSPSFLSASVGDRVTITCSASSSLSYMHWYQQKPGKSPKRWIYDTSKLASGVPSRFSGSGSGTEYTLTISSLQPEDFATYYCQQWSSNPWTFGGGTKVEIKR

SEQ ID NO: 402 - protein, 763 aa, Artificial Sequence
  Description of Artificial Sequence: Synthetic polypeptide
EVQLVQSGAEVKEPGASVKVSCKASGDTFNRYYVHWARQAPGQGLEWMGIINPSGVSTTYAQKFQGRVTMTRDTPTNTVYMELGSLRPEDTAVYFCAESRGSGYNYFAMDVWGQGTLVTVSSDLSGGGGSGGGGSGGGGSGGGGSTGSYELTQPPSVSVSPGQTADITCSGDKLGDKYASWYQQKPGQSPVLVIYQDNRRPSGIPERFSGSNSGNTATLTISGTQAMDEADYYCQAWDSDTYVFGPGTKVTVLGLEEPKSSDKTHTCPPCPAPELLGGPSVFLFPPKPKDTLMISRTPEVTCVVVDVSHEDPEYKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIDIQLTQSPSFLSASVGDRVTITCSASSSLSYMHWYQQKPGKSPKRWIYDTSKLASGVPSRFSGSGSGTEYTLTISSLQPEDFATYYCQQWSSNPWTFGGGTKVEIKRDLSGGGGSGGGGSGGGGSGGGGSTGEVQLVQSGAEVKKPGSSVKVSCKASGYTFTSYWMHWVRQAPGQGLEWIGNIDPSNGETHYNQKFKDRATLTVDKSTSTAYMELSSLRSEDTAVYYCARERIYYSGSTYDGYFDVWGQGTTVTVSS

SEQ ID NO: 403 - protein, 754 aa, Artificial Sequence
  Description of Artificial Sequence: Synthetic polypeptide
EVQLVQSGAEVKKPGSSVKVSCKASGYTFTDYYINWVRQAPGQGLEWIGWIFPGSGSVYCNEQFKGRATLTVDRSTSTAYMELSSLRSEDTAVYFCASSLGKFAYWGQGTLVTVSSDLSGGGGSGGGGSGGGGSGGGGSTGDIQMTQSPSSLSASVGDRVTITCKASQSVVTAVAWYQQKPGKSPKLLIYSASNRYTGVPSRFSGSGSGTDFTLTISSLQPEDFATYFCQQYSSYPYTFGGGTKVEIKREPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDISYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQDLSGGGGSGGGGSGGGGSGGGGSTGEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 404 - protein, 754 aa, Artificial Sequence
  Description of Artificial Sequence: Synthetic polypeptide
DIQMTQSPSSLSASVGDRVTITCKASQSVVTAVAWYQQKPGKSPKLLIYSASNRYTGVPSRFSGSGSGTDFTLTISSLQPEDFATYFCQQYSSYPYTFGGGTKVEIKRDLSGGGGSGGGGSGGGGSGGGGSTGEVQLVQSGAEVKKPGSSVKVSCKASGYTFTDYYINWVRQAPGQGLEWIGWIFPGSGSVYCNEQFKGRATLTVDRSTSTAYMELSSLRSEDTAVYFCASSLGKFAYWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDISYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQDLSGGGGSGGGGSGGGGSGGGGSTGEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 405 - protein, 752 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSDLSGGGGSGGGGSGGGGSGGGGSTGDAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKRVERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKVDGASSPVNVSSPSVQDIEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSDLSGGGGSGGGGSGGGGSGGGGSTGSYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQ

SEQ ID NO: 406 - protein, 757 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSDLSGGGGSGGGGSGGGGSGGGGSTGDAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKRLEEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDISYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQDLSGGGGSGGGGSGGGGSGGGGSTGEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 407 - protein, 756 aa, Artificial Sequence
  Description of Artificial Sequence: Synthetic polypeptide
DAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKRDLSGGGGSGGGGSGGGGSGGGGSTGEVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSREPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSDLSGGGGSGGGGSGGGGSGGGGSTGSYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQ

SEQ ID NO: 408 - protein, 756 aa, Artificial Sequence
  Description of Artificial Sequence: Synthetic polypeptide
DAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKRDLSGGGGSGGGGSGGGGSGGGGSTGEVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSREPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDISYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQDLSGGGGSGGGGSGGGGSGGGGSTGEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 409 - protein, 754 aa, Artificial Sequence
  Description of Artificial Sequence: Synthetic polypeptide
EVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSDLSGGGGSGGGGSGGGGSGGGGSTGSYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIDIQMTQSPSSLSASVGDRVTITCKASQSVVTAVAWYQQKPGKSPKLLIYSASNRYTGVPSRFSGSGSGTDFTLTISSLQPEDFATYFCQQYSSYPYTFGGGTKVEIKRDLSGGGGSGGGGSGGGGSGGGGSTGEVQLVQSGAEVKKPGSSVKVSCKASGYTFTDYYINWVRQAPGQGLEWIGWIFPGSGSVYCNEQFKGRATLTVDRSTSTAYMELSSLRSEDTAVYFCASSLGKFAYWGQGTLVTVSS

SEQ ID NO: 410 - protein, 754 aa, Artificial Sequence
  Description of Artificial Sequence: Synthetic polypeptide
SYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQDLSGGGGSGGGGSGGGGSGGGGSTGEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIEVQLVQSGAEVKKPGSSVKVSCKASGYTFTDYYINWVRQAPGQGLEWIGWIFPGSGSVYCNEQFKGRATLTVDRSTSTAYMELSSLRSEDTAVYFCASSLGKFAYWGQGTLVTVSSDLSGGGGSGGGGSGGGGSGGGGSTGDIQMTQSPSSLSASVGDRVTITCKASQSVVTAVAWYQQKPGKSPKLLIYSASNRYTGVPSRFSGSGSGTDFTLTISSLQPEDFATYFCQQYSSYPYTFGGGTKVEIKR

SEQ ID NO: 411 - protein, 754 aa, Artificial Sequence
  Description of Artificial Sequence: Synthetic polypeptide
SYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQDLSGGGGSGGGGSGGGGSGGGGSTGEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIDIQMTQSPSSLSASVGDRVTITCKASQSVVTAVAWYQQKPGKSPKLLIYSASNRYTGVPSRFSGSGSGTDFTLTISSLQPEDFATYFCQQYSSYPYTFGGGTKVEIKRDLSGGGGSGGGGSGGGGSGGGGSTGEVQLVQSGAEVKKPGSSVKVSCKASGYTFTDYYINWVRQAPGQGLEWIGWIFPGSGSVYCNEQFKGRATLTVDRSTSTAYMELSSLRSEDTAVYFCASSLGKFAYWGQGTLVTVSS

SEQ ID NO: 412 - protein, 755 aa, Artificial Sequence
  Description of Artificial Sequence: Synthetic polypeptide
SYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQDLSGGGGSGGGGSGGGGSGGGGSTGEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIEVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSDLSGGGGSGGGGSGGGGSGGGGSTGDAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKR

SEQ ID NO: 413 - protein, 758 aa, Artificial Sequence
  Description of Artificial Sequence: Synthetic polypeptide
QVQLQQSGPELVKPGASVRISCKASGYTFTTYYIHWVKQRPGQGLEWIGWIYPGNVNTNYNEKFKGKATLTADKSSSTAYMQLTSLTSEDSAVYFCARGVYYFDYWGQGTILTVSSDLSGGGGSGGGGSGGGGSGGGGSTGSIVMTQTPKFLLVSAGDRVTITCKASQSVNNDVSWFQQKPGQSPTLLIYYASNRYTGVPDRFTGSGYGTDFTFTISTVQAEDLAVYFCQQDYSSPYTFGGGTKLEIKRLEEPKSSDKTHTCPPCPAPELLGGPSVFLFPPKPKDTLMISRTPEVTCVVVDVSHEDPEYKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIEVQLVQSGAEVKKPGSSVKVSCKASGYTFTSYWMHWVRQAPGQGLEWIGNIDPSNGETHYNQKFKDRATLTVDKSTSTAYMELSSLRSEDTAVYYCARERIYYSGSTYDGYFDVWGQGTTVTVSSDLSGGGGSGGGGSGGGGSGGGGSTGDIQLTQSPSFLSASVGDRVTITCSASSSLSYMHWYQQKPGKSPKRWIYDTSKLASGVPSRFSGSGSGTEYTLTISSLQPEDFATYYCQQWSSNPWTFGGGTKVEIKR

SEQ ID NO: 414 - protein, 758 aa, Artificial Sequence
  Description of Artificial Sequence: Synthetic polypeptide
SIVMTQTPKFLLVSAGDRVTITCKASQSVNNDVSWFQQKPGQSPTLLIYYASNRYTGVPDRFTGSGYGTDFTFTISTVQAEDLAVYFCQQDYSSPYTFGGGTKLEIKRDLSGGGGSGGGGSGGGGSGGGGSTGQVQLQQSGPELVKPGASVRISCKASGYTFTTYYIHWVKQRPGQGLEWIGWIYPGNVNTNYNEKFKGKATLTADKSSSTAYMQLTSLTSEDSAVYFCARGVYYFDYWGQGTILTVSSLEEPKSSDKTHTCPPCPAPELLGGPSVFLFPPKPKDTLMISRTPEVTCVVVDVSHEDPEYKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIEVQLVQSGAEVKKPGSSVKVSCKASGYTFTSYWMHWVRQAPGQGLEWIGNIDPSNGETHYNQKFKDRATLTVDKSTSTAYMELSSLRSEDTAVYYCARERIYYSGSTYDGYFDVWGQGTTVTVSSDLSGGGGSGGGGSGGGGSGGGGSTGDIQLTQSPSFLSASVGDRVTITCSASSSLSYMHWYQQKPGKSPKRWIYDTSKLASGVPSRFSGSGSGTEYTLTISSLQPEDFATYYCQQWSSNPWTFGGGTKVEIKR

SEQ ID NO: 415 - protein, 764 aa, Artificial Sequence
  Description of Artificial Sequence: Synthetic polypeptide
DVQLQESGPGLVKPSQSLSLTCSVTGYSITSGYYWNWIRQFPGSKLEWMGYISYDGNNNYNPSLKNRISITRDTSKNQFFLKLNSVTTEDTATYYCARERYYDYDGYAVDYWGQGTSVTVSSDLSGGGGSGGGGSGGGGSGGGGSTGDIQMTQSPASLSVSVGETVTITCRASENIYSNLAWYQQKQGKSPQLLVYGATNLADGVTSRFSGSGSGTQYSLKINSLQSEDFGSYYCQNFWGTTWTFGGGTKLEIKRLEEPKSSDKTHTCPPCPAPELLGGPSVFLFPPKPKDTLMISRTPEVTCVVVDVSHEDPEYKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIEVQLVQSGAEVKKPGSSVKVSCKASGYTFTSYWMHWVRQAPGQGLEWIGNIDPSNGETHYNQKFKDRATLTVDKSTSTAYMELSSLRSEDTAVYYCARERIYYSGSTYDGYFDVWGQGTTVTVSSDLSGGGGSGGGGSGGGGSGGGGSTGDIQLTQSPSFLSASVGDRVTITCSASSSLSYMHWYQQKPGKSPKRWIYDTSKLASGVPSRFSGSGSGTEYTLTISSLQPEDFATYYCQQWSSNPWTFGGGTKVEIKR

SEQ ID NO: 416 - protein, 764 aa, Artificial Sequence
  Description of Artificial Sequence: Synthetic polypeptide
DIQMTQSPASLSVSVGETVTITCRASENIYSNLAWYQQKQGKSPQLLVYGATNLADGVTSRFSGSGSGTQYSLKINSLQSEDFGSYYCQNFWGTTWTFGGGTKLEIKRDLSGGGGSGGGGSGGGGSGGGGSTGDVQLQESGPGLVKPSQSLSLTCSVTGYSITSGYYWNWIRQFPGSKLEWMGYISYDGNNNYNPSLKNRISITRDTSKNQFFLKLNSVTTEDTATYYCARERYYDYDGYAVDYWGQGTSVTVSSLEEPKSSDKTHTCPPCPAPELLGGPSVFLFPPKPKDTLMISRTPEVTCVVVDVSHEDPEYKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIEVQLVQSGAEVKKPGSSVKVSCKASGYTFTSYWMHWVRQAPGQGLEWIGNIDPSNGETHYNQKFKDRATLTVDKSTSTAYMELSSLRSEDTAVYYCARERIYYSGSTYDGYFDVWGQGTTVTVSSDLSGGGGSGGGGSGGGGSGGGGSTGDIQLTQSPSFLSASVGDRVTITCSASSSLSYMHWYQQKPGKSPKRWIYDTSKLASGVPSRFSGSGSGTEYTLTISSLQPEDFATYYCQQWSSNPWTFGGGTKVEIKR

SEQ ID NO: 417 - protein, 761 aa, Artificial Sequence
  Description of Artificial Sequence: Synthetic polypeptide
EVQLVESGGGLVQPGGSLRLSCAASGFSLTNYGVHWVRQAPGKGLEWLGVIWSGGNTDYNTPFTSRLTINKDNSKNTVYLQMNSLRAEDTAVYYCARALTYYDYEFAYWGQGTLVTVSSDLSGGGGSGGGGSGGGGSGGGGSTGDILLTQSPGTLSLSPGERATLSCRASQSIYTNIHWYQQKPGQAPRLLIKYASESISGIPDRFSGSGSGTDFTLTISRLEPEDFAVYYCQQNNNWPTTFGQGTKLEIKRLEEPKSSDKTHTCPPCPAPELLGGPSVFLFPPKPKDTLMISRTPEVTCVVVDVSHEDPEYKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIEVQLVQSGAEVKKPGSSVKVSCKASGYTFTSYWMHWVRQAPGQGLEWIGNIDPSNGETHYNQKFKDRATLTVDKSTSTAYMELSSLRSEDTAVYYCARERIYYSGSTYDGYFDVWGQGTTVTVSSDLSGGGGSGGGGSGGGGSGGGGSTGDIQLTQSPSFLSASVGDRVTITCSASSSLSYMHWYQQKPGKSPKRWIYDTSKLASGVPSRFSGSGSGTEYTLTISSLQPEDFATYYCQQWSSNPWTFGGGTKVEIKR

SEQ ID NO: 418 - protein, 761 aa, Artificial Sequence
  Description of Artificial Sequence: Synthetic polypeptide
DILLTQSPGTLSLSPGERATLSCRASQSIYTNIHWYQQKPGQAPRLLIKYASESISGIPDRFSGSGSGTDFTLTISRLEPEDFAVYYCQQNNNWPTTFGQGTKLEIKRDLSGGGGSGGGGSGGGGSGGGGSTGEVQLVESGGGLVQPGGSLRLSCAASGFSLTNYGVHWVRQAPGKGLEWLGVIWSGGNTDYNTPFTSRLTINKDNSKNTVYLQMNSLRAEDTAVYYCARALTYYDYEFAYWGQGTLVTVSSLEEPKSSDKTHTCPPCPAPELLGGPSVFLFPPKPKDTLMISRTPEVTCVVVDVSHEDPEYKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKVDGASSPVNVSSPSVQDIEVQLVQSGAEVKKPGSSVKVSCKASGYTFTSYWMHWVRQAPGQGLEWIGNIDPSNGETHYNQKFKDRATLTVDKSTSTAYMELSSLRSEDTAVYYCARERIYYSGSTYDGYFDVWGQGTTVTVSSDLSGGGGSGGGGSGGGGSGGGGSTGDIQLTQSPSFLSASVGDRVTITCSASSSLSYMHWYQQKPGKSPKRWIYDTSKLASGVPSRFSGSGSGTEYTLTISSLQPEDFATYYCQQWSSNPWTFGGGTKVEIKR

SEQ ID NO: 419 - protein, 765 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSGGGGSDAVMTQTPLSLSVTPGQPASISCRSSQSLENTNGNTFLNWYLQKPGQSPQLLIYRVSNRFSGVPDRFSGSGSGTDFTLKISRVEAEDVGVYYCLQVTHVPFTFGQGTKLEIKREPKSSDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSSYELTQPPSVSVAPGQTARISCSGDKLGDKYASWYQQKPGQAPVLVIYQDNRRPSGIPERFSGSNSGNTATLTISGTQAEDEADYYCQAWDSDTYVFGGGTKLTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 420 - protein, 765 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKREPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSSYELTQPPSVSVAPGQTARISCSGDKLGDKYASWYQQKPGQAPVLVIYQDNRRPSGIPERFSGSNSGNTATLTISGTQAEDEADYYCQAWDSDTYVFGGGTKLTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 421 - protein, 765 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKREPKSSDKTHTCPPCPAPELLGGPSVFLFPPKPKDTLMISRTPEVTCVLVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSSYELTQPPSVSVAPGQTARISCSGDKLGDKYASWYQQKPGQAPVLVIYQDNRRPSGIPERFSGSNSGNTATLTISGTQAEDEADYYCQAWDSDTYVFGGGTKLTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 422 - protein, 763 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKREPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSSYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 423 - protein, 763 aa, Artificial Sequence
  Description of Artificial Sequence: Synthetic polypeptide
EVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKREPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSGGGGSGGGGSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYITPLTFGGGTKVEIK

SEQ ID NO: 424 - protein, 763 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYITPLTFGGGTKVEIKGGGGSGGGGSGGGGSGGGGSGGGGSGGGGSEVQLLESGGGLVQPGGSLRLSCAASGFTFSSYAMSWVRQAPGKGLEWVSAISGGGGRTYYADSVKGRFTISRDNSKNTLYLQMNSLRAEDTAVYYCAREEMAFRAYRFDIWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKR

SEQ ID NO: 425 - protein, 763 aa, Artificial Sequence
  Description of Artificial Sequence: Synthetic polypeptide
SYELTQPPSVSVAPGQTARISCSGDKLGDKYASWYQQKPGQAPVLVIYQDNRRPSGIPERFSGSNSGNTATLTISGTQAEDEADYYCQAWDSDTYVFGGGTKLTVLGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLQESGPGLVKPSETLSLTCTVSGYSITSNYYWNWIRQPPGKGLEWMGYIRYDGSNNYNPSLKNRVTISRDTSKNQFSLKLSSVTAADTAVYYCARLDYWGQGTTVTVSSGGGGSGGGGSGGGGSGGGGSGGGGSGGGGSDAQMTQSPSSLSASVGDRVTITCRSSQSLENTNGNTFLNWFQQKPGKAPKLLIYRVSNRFSGVPSRFSGSGSGTDFTLTISSLQPEDFATYYCLQVTHVPFTFGQGTKLEIKR

SEQ ID NO: 426-430 - skipped (5 entries)

SEQ ID NO: 431 - protein, 774 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSSYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 432 - protein, 774 aa, Artificial Sequence
  Description of Artificial Sequence: Synthetic polypeptide
NVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQGGGGSGGGGSGGGGSGGGGSGGGGSGGGGSEVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSSYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 433 - protein, 774 aa, Artificial Sequence
  Description of Artificial Sequence: Synthetic polypeptide
SYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQ

SEQ ID NO: 434 - protein, 774 aa, Artificial Sequence
  Description of Artificial Sequence: Synthetic polypeptide
SYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQGGGGSGGGGSGGGGSGGGGSGGGGSGGGGSEVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSS

SEQ ID NO: 435 - protein, 770 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQERKCCVECPPCPAPPAAAPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGGGSGGGSGGGGSSYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 436 - protein, 770 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQERKSSVECPPCPAPPAAAPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGGGSGGGSGGGGSSYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 437 - protein, 771 aa, Artificial Sequence
  Description of Artificial Sequence: Synthetic polypeptide
EVQLVQSGAEVKKPGSSVKVSCKASDYTFNDYWVSWVRQAPGQGLEWIGEIYPNSGATNFNGKFRGRATLTVDNSASTAYMELSSLRSEDTAVYYCTREYTRDWFAYWGQGTLVTVSSGGGGSGGGGSGGGGSGGGGSGGGGSGGGGSDVVLTQSPLSLPVTLGQPASISCRSSQSLLDSDGNTYLYWFQQRPGQSPRRLIYLVSNLGSGVPDRFSGSGSGTDFTLKISRVEAEDVGVYYCMQPTHAPYTFGQGTKLEIKREPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSSYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 438 - protein, 771 aa, Artificial Sequence
  Description of Artificial Sequence: Synthetic polypeptide
DVVLTQSPLSLPVTLGQPASISCRSSQSLLDSDGNTYLYWFQQRPGQSPRRLIYLVSNLGSGVPDRFSGSGSGTDFTLKISRVEAEDVGVYYCMQPTHAPYTFGQGTKLEIKRGGGGSGGGGSGGGGSGGGGSGGGGSGGGGSEVQLVQSGAEVKKPGSSVKVSCKASDYTFNDYWVSWVRQAPGQGLEWIGEIYPNSGATNFNGKFRGRATLTVDNSASTAYMELSSLRSEDTAVYYCTREYTRDWFAYWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSSYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSS

SEQ ID NO: 439 - protein, 771 aa, Artificial Sequence
  Description of Artificial Sequence: Synthetic polypeptide
SYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSEVQLVQSGAEVKKPGSSVKVSCKASDYTFNDYWVSWVRQAPGQGLEWIGEIYPNSGATNFNGKFRGRATLTVDNSASTAYMELSSLRSEDTAVYYCTREYTRDWFAYWGQGTLVTVSSGGGGSGGGGSGGGGSGGGGSGGGGSGGGGSDVVLTQSPLSLPVTLGQPASISCRSSQSLLDSDGNTYLYWFQQRPGQSPRRLIYLVSNLGSGVPDRFSGSGSGTDFTLKISRVEAEDVGVYYCMQPTHAPYTFGQGTKLEIKR

SEQ ID NO: 440 - protein, 771 aa, Artificial Sequence
  Description of Artificial Sequence: Synthetic polypeptide
SYELTQPPSVSVSPGQTASITCSGDKLGDKYASWYQQKPGQSPVLVIYQDNRRPSGIPERFSGSNSGNTATLTISGTQAMDEADYYCQAWDSDTYVFGTGTKVTVLGQGGGGSGGGGSGGGGSGGGGSGGGGSGGGGSEVQLVQSGAEVKKPGASVKVSCKASGDTFKRYYVHWVRQAPGQGLEWMGIINPSGVSTTYAQKFQGRVTMTRDTSTSTVYMELSSLRSEDTAVYYCAEVRGSGFNYFGMDVWGQGTLVTVSSEPKSSDKTHTCPPCPAPELLGGPSVFLFPPKPKDTLMISRTPEVTCVVVDVSHEDPEEKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGSGGGGSDVVLTQSPLSLPVTLGQPASISCRSSQSLLDSDGNTYLYWFQQRPGQSPRRLIYLVSNLGSGVPDRFSGSGSGTDFTLKISRVEAEDVGVYYCMQPTHAPYTFGQGTKLEIKRGGGGSGGGGSGGGGSGGGGSGGGGSGGGGSEVQLVQSGAEVKKPGSSVKVSCKASDYTFNDYWVSWVRQAPGQGLEWIGEIYPNSGATNFNGKFRGRATLTVDNSASTAYMELSSLRSEDTAVYYCTREYTRDWFAYWGQGTLVTVSS

SEQ ID NO: 441 - protein, 767 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKGGGGSGGGSGGGSGGGGSDIQMTQSPSSLSASVGDRVTITCSASQGISNYLNWYQQKPGKAVKLLIYYTSRLHSGVPSRFSGSGSGTDFTLTISSLQPEDFATYYCQQYSKLPYTFGGGTKVEIKRGGGGSGGGGSGGGGSGGGGSGGGGSGGGGSEVQLVQSGAEVKKPGSSVKVSCKTSGYTFTSYWMHWVRQAPGQGLEWIGEIDPSDSYINYNQKFKGRATLTVDKSTSTAYMELSSLRSEDTAVYYCARGPRDYWGQGTTVTVSS

SEQ ID NO: 442 - protein, 767 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKGGGGSGGGSGGGSGGGGSEVQLVQSGAEVKKPGSSVKVSCKTSGYTFTSYWMHWVRQAPGQGLEWIGEIDPSDSYINYNQKFKGRATLTVDKSTSTAYMELSSLRSEDTAVYYCARGPRDYWGQGTTVTVSSGGGGSGGGGSGGGGSGGGGSGGGGSGGGGSDIQMTQSPSSLSASVGDRVTITCSASQGISNYLNWYQQKPGKAVKLLIYYTSRLHSGVPSRFSGSGSGTDFTLTISSLQPEDFATYYCQQYSKLPYTFGGGTKVEIKR

SEQ ID NO: 443 - protein, 781 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKGGGGSGGGSGGGSGGGGSDIVMTQSPDSLAVSLGERATINCKSSQSLLNSRTRKSYLAWYQQKPGQPPKVLIYWASSRESGVPDRFSGSGSGTDFTLTISSLQAEDVAVYYCKQSYNLYTFGGGTKVEIKRGGGGSGGGGSGGGGSGGGGSGGGGSGGGGSEVQLVQSGAEVKKPGSSVKVSCKASGYTFTTYWMQWVRQAPGQGLEWMGAIYPGDGDTRYTQKFKGRVTLTADKSTSTAYMELSSLRSEDTAVYYCARGRDYSGSSWTWFAYWGQGTLVTVSS

SEQ ID NO: 444 - protein, 781 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKGGGGSGGGSGGGSGGGGSEVQLVQSGAEVKKPGSSVKVSCKASGYTFTTYWMQWVRQAPGQGLEWMGAIYPGDGDTRYTQKFKGRVTLTADKSTSTAYMELSSLRSEDTAVYYCARGRDYSGSSWTWFAYWGQGTLVTVSSGGGGSGGGGSGGGGSGGGGSGGGGSGGGGSDIVMTQSPDSLAVSLGERATINCKSSQSLLNSRTRKSYLAWYQQKPGQPPKVLIYWASSRESGVPDRFSGSGSGTDFTLTISSLQAEDVAVYYCKQSYNLYTFGGGTKVEIKR

SEQ ID NO: 445 - protein, 772 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKGGGGSGGGSGGGSGGGGSEVKLVESEGGLVQPGSSMKLSCTASGFTFSDYYMAWVRQVPEKGLEWVANINYDGTTTYYLDSLKSRFIISRDNSKNILYLQMSSLKSEDTATYYCARVLDGYYGYFDYWGQGTTLSVSSGGGGSGGGGSGGGGSGGGGSGGGGSGGGGSQIVLTQSPAIMSASPGEKVTISCSASSSVSYMYWYQQKPGSSPKPWIYRTYNLASGVPARFSGSGSGTSYSLTISSMEAEDAATYYCQQSHTYPPTFGGGTKLEIKR

SEQ ID NO: 446 - protein, 772 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKGGGGSGGGSGGGSGGGGSQIVLTQSPAIMSASPGEKVTISCSASSSVSYMYWYQQKPGSSPKPWIYRTYNLASGVPARFSGSGSGTSYSLTISSMEAEDAATYYCQQSHTYPPTFGGGTKLEIKRGGGGSGGGGSGGGGSGGGGSGGGGSGGGGSEVKLVESEGGLVQPGSSMKLSCTASGFTFSDYYMAWVRQVPEKGLEWVANINYDGTTTYYLDSLKSRFIISRDNSKNILYLQMSSLKSEDTATYYCARVLDGYYGYFDYWGQGTTLSVSS

SEQ ID NO: 447 - protein, 766 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQVPRDSGCKPCICTVPEVSSVFIFPPKPKDVLMITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKGGGGSGGGSGGGSGGGGSEVKLVESEGGLVQPGSSMKLSCTASGFTFSDYYMAWVRQVPEKGLEWVANINYDGTTTYYLDSLKSRFIISRDNSKNILYLQMSSLKSEDTATYYCARVLDGYYGYFDYWGQGTTLSVSSGGGGSGGGGSGGGGSGGGGSGGGGSGGGGSQIVLTQSPAIMSASPGEKVTISCSASSSVSYMYWYQQKPGSSPKPWIYRTYNLASGVPARFSGSGSGTSYSLTISSMEAEDAATYYCQQSHTYPPTFGGGTKLEIKR

SEQ ID NO: 448 - protein, 766 aa, Artificial Sequence
  Description of Artificial Sequence: Synthetic polypeptide
EVQLVQSGAEVKKPGSSVKVSCKASGYTFTSYYIYWVRQAPGQGLEWIGNIWPGNGGTFYGEKFMGRATFTADTSTSTAYMELSSLRSEDTAVYYCARRPDYSGDDYFDYWGQGTLVTVSSGGGGSGGGGSGGGGSGGGGSGGGGSGGGGSNVMLTQPHSVSESPGKTVTISCKLNSGNIGSYYVHWYQQRPGSSPTTMIYRDDKRPDGVPDRFSGSIDSSSNSASLTISGLKTEDEADYYCHSYDSTITPVFGGGTKLTVLGQVPRDSGCKPCICTVPEVSSVFIFPPKPKDVLMITLTPKVTCVVVDISKDDPEVQFSWFVDDVEVHTAQTQPREEQFASTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKGGGGSGGGSGGGSGGGGSEVKLVESEGGLVQPGSSMKLSCTASGFTFSDYYMAWVRQVPEKGLEWVANINYDGTTTYYLDSLKSRFIISRDNSKNILYLQMSSLKSEDTATYYCARVLDGYYGYFDYWGQGTTLSVSSGGGGSGGGGSGGGGSGGGGSGGGGSGGGGSQIVLTQSPAIMSASPGEKVTISCSASSSVSYMYWYQQKPGSSPKPWIYRTYNLASGVPARFSGSGSGTSYSLTISSMEAEDAATYYCQQSHTYPPTFGGGTKLEIKR

The invention claimed is:

1. A bispecific binding protein capable of binding CD40 and capable of binding mesothelin, comprising two polypeptides of formula (II):

$$scFv^X-H-Fc-L-scFv^Y \quad (II),$$

wherein
L is a polypeptide linker,
H is a hinge region,
Fc comprises CH2 and CH3 regions of an immunoglobulin,
scFv$^X$ and ScFv$^Y$ are each independently a single chain variable fragment,
scFv$^X$ specifically binds a first antigen,
scFv$^Y$ specifically binds a second antigen, and
one of the two antigens is CD40 and the other is mesothelin; and
wherein the scFv that binds CD40 comprises a V$_H$ having a CDR-H1 according to SEQ ID NO:25, a CDR-H2 according to SEQ ID NO:26, and a CDR-H3 according to SEQ ID NO:27, and a V$_L$ having a CDR-L1 according to SEQ ID NO:55, a CDR-L2 according to SEQ ID NO:56, and a CDR-L3 according to SEQ ID NO:57; and
wherein the scFv that binds mesothelin comprises a V$_H$ having a CDR-H1 according to SEQ ID NO:241, a CDR-H2 according to SEQ ID NO:242, and a CDR-H3 according to SEQ ID NO:243, and a V$_L$ having a CDR-L1 according to SEQ ID NO:244, a CDR-L2 according to SEQ ID NO:245, and a CDR-L3 according to SEQ ID NO:246.

2. The bispecific binding protein of claim 1, wherein the scFv that binds CD40 comprises a V$_H$ according to SEQ ID NO:17 and a V$_L$ according to SEQ ID NO:44.

3. The bispecific binding protein of claim 1, wherein the scFv that binds mesothelin comprises a V$_H$ according to SEQ ID NO:120 and a V$_L$ according to SEQ ID NO:137.

4. The bispecific binding protein of claim 1, wherein the scFv that binds CD40 comprises a V$_H$ according to SEQ ID NO:17 and a V$_L$ according to SEQ ID NO:44, and wherein the scFv that binds mesothelin comprises a V$_H$ according to SEQ ID NO:120 and a V$_L$ according to SEQ ID NO:137.

5. The bispecific binding protein of claim 1, wherein the two polypeptides each comprise the amino acid sequence of SEQ ID NO:406.

6. A pharmaceutical composition comprising a bispecific binding protein of claim 5, and a pharmaceutically acceptable carrier.

7. A bispecific binding protein capable of binding CD40 and capable of binding mesothelin, comprising two polypeptides of formula (III):

$$Fab-H-Fc-L-scFv^Y \quad (III),$$

wherein
L is a polypeptide linker,
H is a hinge region,
Fc comprises CH2 and CH3 regions of an immunoglobulin,
Fab is a fragment antigen-binding region,
scFv$^Y$ is a single chain variable fragment,
Fab specifically binds a first antigen,
scFv$^Y$ specifically binds a second antigen, and
the first antigen is mesothelin and the second antigen is CD40; and
wherein the scFv that binds CD40 comprises a V$_H$ having a CDR-H1 according to SEQ ID NO:25, a CDR-H2 according to SEQ ID NO:26, and a CDR-H3 according to SEQ ID NO:27, and a V$_L$ having a CDR-L1 according to SEQ ID NO:55, a CDR-L2 according to SEQ ID NO:56, and a CDR-L3 according to SEQ ID NO:57; and
wherein the scFv that binds mesothelin comprises a V$_H$ having a CDR-H1 according to SEQ ID NO:241, a CDR-H2 according to SEQ ID NO:242, and a CDR-H3 according to SEQ ID NO:243, and a V$_L$ having a CDR-L1 according to SEQ ID NO:244, a CDR-L2 according to SEQ ID NO:245, and a CDR-L3 according to SEQ ID NO:246.

8. A pharmaceutical composition comprising a bispecific binding protein of claim 7, and a pharmaceutically acceptable carrier.

9. The bispecific binding protein of claim 1, wherein the first antigen is CD40 and the second antigen is mesothelin.

10. The bispecific binding protein of claim 1, wherein the first antigen is mesothelin and the second antigen is CD40.

* * * * *